United States Patent 12,152,077 (IMMUNOTHERAPY TARGETING TUMOR NEOANTIGENIC PEPTIDES) - sequence listing, part 2

SEQ ID NO: 575 - DNA, 7195 bp, synthetic construct
  misc_feature 1..7195: note = Synthetic polynucleotide
  source 1..7195: mol_type = other DNA
tgatatggtttgtctgtgtccgcacagccaaatctcatcttgaattcccatgtgttgtgggaggcacctggtgggaggtaattgaatcatgggggcgggtctttcccatgctgttctcatgatagcgcataagtctcatgagatctgatggttttgaaaagggggagtttccctgcccaaactctctttttgcctgctgccatccgtgtaagatgtgacttggtcctccttgccttccgccatgattgtgaggtctccccagccacgtggaactggccagcagcttgaccttggcacaccacataatctgagtgaaccgtgtatccaaggatgtcacttttggaactctgtagatcagaaaaactgtgctttaaagtgtcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccaatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcgcaggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcaggaccaacttcagttattcagaaattttttcttaaatagcatttataagtccagagatgaagcaaacaacagtggagtcataaatgaaagctttgaaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaa

SEQ ID NO: 576 - DNA, 2471 bp, synthetic construct
  misc_feature 1..2471: note = Synthetic polynucleotide
  source 1..2471: mol_type = other DNA
gccaggcgtggtggttcacgcctataatcccagcactttgggaggctgaggcaggtggatcacgaggtcaggagatcgacaccatcctggccaacatggtgaaaccccatctctactaaaatacaaaagattagccaggcgtggtggtgggcgcctgtaatcccacctactcaggaggctgaggcaggagaatcgcttgaatccaggaggcagagagtgcagtgagatgccaccgttctccagcctggcgacagaggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctga

SEQ ID NO: 577 - DNA, 2471 bp, synthetic construct; identical to SEQ ID NO: 576
  misc_feature 1..2471: note = Synthetic polynucleotide
  source 1..2471: mol_type = other DNA

SEQ ID NO: 578 - DNA, 2471 bp, synthetic construct; identical to SEQ ID NO: 576
  misc_feature 1..2471: note = Synthetic polynucleotide
  source 1..2471: mol_type = other DNA

SEQ ID NO: 579 - DNA, 1407 bp, synthetic construct
  misc_feature 1..1407: note = Synthetic polynucleotide
  source 1..1407: mol_type = other DNA
aatgttatttctcatcaaacaaacttgacagtagttccaaatagccagaaaatggcactttgaatttttccatcctgcaagatctaaataattcttataataaaataggcaaatggtctgaggtgcctgacatccaggcattcttttacaaatcagtcccttcctagtctctgtgcccagtgcaactcgtcccaagtcttccttctttccctcccgcctgtcccctcagtaccatcccaagcgttgctgagtctttctaatcttccttttctacagacccatctaacctgtcccttcctccccaggctgctccttgccaggccgagctaggtcccaattcttcctcagcctccgctcctccaccctataatctttttatcgcctcccctcctcacgcctggtctaccttacagtttccttctgtgactggccctccccgacctgcccagcaatttactcttaaaaaggtggctggagctaaaggcatagtcaaagttaatgctcctttttctttatcccaaatcagatagcgtttaggctctttgtcatcaaatataaaaacccagcccagttcatgacttgtttggcagcaaccctgagacgctttacagccctagaacctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaacacctgaaccgcagccgccaggtgttcctccagaacctcctcccagaggagcttgctacacgtgccggaaatctggccactgggccaaggaatgcccgcagcctgggattcctcctaagcttcgtcccatctgtgtgggaccccactgaaaatcggactgttcaactcacctgacacccactcccagagcccctggaactctggcccaaggctctctgactgattccttcccagatcttctcggcttagtggctgaagactgacactgcccgatcacctcggaagccccctagaccatcacggacgccgagcttcgggtaactctcacagtggaagctactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggaggcgctatcacacttggtgtga

SEQ ID NO: 580 - DNA, 1084 bp, synthetic construct
  misc_feature 1..1084: note = Synthetic polynucleotide
  source 1..1084: mol_type = other DNA
ggcctccacatacagttgctcaggttgtatactgcacgagggcatccaaccaaggactcaagggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctga

SEQ ID NO: 581 - DNA, 1815 bp, synthetic construct
  misc_feature 1..1815: note = Synthetic polynucleotide
  source 1..1815: mol_type = other DNA
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaagtgaggagcccctctgcccggccagcaccccgtccgggagggaggtgggggggtcagccccccgcccggccagccgccccgtccgggagggaggtggggggggtcagcccccccgcccggccagccgccccgtccgggaggtgaggggcgcctctgcccggccgcccctactgggaagtgaggagcccctctgcccggccagcaccccgtccgggagggaggtgggggggtcagccccccgcccggccagccgccccgtccgggagggaggtggggggggggtcagcccccccgcctggccagccgccccatccgggaggtgaggggcgcctctgcccggcggcccctactgggaagtgaggagcccctctgcccggccagccgccccgtccgggagggaggtggggggggtcagcccccccgcccggccagccgccccgtccgggaggtgaggggcgcctctgcccggccgcccctactgggaagtgaggagcccctctgcccggccagccgccccgtccgggagggaggtgggggggtcagcccccccgctcggccagccgccccgtccgggagggaggtggggggggtcagcccccctgcccggccagccgccccgtccgggagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 582 - DNA, 858 bp, synthetic construct
  misc_feature 1..858: note = Synthetic polynucleotide
  source 1..858: mol_type = other DNA
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaagtgaggagaccctccgcccggcaaccgccccgtctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaa

SEQ ID NO: 583 - DNA, 921 bp, synthetic construct
  misc_feature 1..921: note = Synthetic polynucleotide
  source 1..921: mol_type = other DNA
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaagtgaggagaccctccgcccggcaaccgccccgtctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaa

SEQ ID NO: 584 - DNA, 858 bp, synthetic construct; identical to SEQ ID NO: 582
  misc_feature 1..858: note = Synthetic polynucleotide
  source 1..858: mol_type = other DNA

SEQ ID NO: 585 - DNA, 778 bp, synthetic construct
  misc_feature 1..778: note = Synthetic polynucleotide
  source 1..778: mol_type = other DNA
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaagtgaggagaccctccgcccggcaaccgccccgtctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagaccc

SEQ ID NO: 586 - DNA, 2534 bp, synthetic construct
  misc_feature 1..2534: note = Synthetic polynucleotide
  source 1..2534: mol_type = other DNA
gctgtaattaagaagtcaacaggaagtaaaaggaaaacataaaccttgtcaagagaaggcgaaaagaagaaaaaagaaaccaagaacagatcaaacaagtaggaaacagccagcaagatggtagattttaatccagccacatcagtgttcaggctgaacatgagtggttttgtttaaaagacaggcattgccatatgggacagaaacgcacagctcggccatacactgcaggaagtcctctttcagcacggaggcagaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctgctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcatcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggctgtgcaccccgacaaggctgcggggcagccgtacgagcagcacgccaagatgatcttcatggagctgaatgacgcctggtcggagtttgagaaccagggctcccggcccctcttctga

SEQ ID NO: 587 - DNA, 2534 bp, synthetic construct; identical to SEQ ID NO: 586
  misc_feature 1..2534: note = Synthetic polynucleotide
  source 1..2534: mol_type = other DNA

SEQ ID NO: 588 - DNA, 463 bp, synthetic construct
  misc_feature 1..463: note = Synthetic polynucleotide
  source 1..463: mol_type = other DNA
aatctggggctcatccaggattcccattctcctccagggaaggggtctctggtcacctctcataaggagacgcatcccactgcctcgttgcggtggcctcagggtgagggatcggaacccacccggtgtgacgaataaatccggactctcagcaatgtggggaaaaaaaggcttgcaacaccatggtgaccaggtaactttgtgcacagaccaagtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatga

SEQ ID NO: 589 - DNA, 463 bp, synthetic construct; identical to SEQ ID NO: 588
  misc_feature 1..463: note = Synthetic polynucleotide
  source 1..463: mol_type = other DNA

SEQ ID NO: 590 - DNA, 1022 bp, synthetic construct
  misc_feature 1..1022: note = Synthetic polynucleotide
  source 1..1022: mol_type = other DNA
ggcggggcgcggtggctcacgtctttaatcccagcactttgggaggccgaggctggcagatcacctgagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtga

SEQ ID NO: 591 - DNA, 347 bp, synthetic construct
  misc_feature 1..347: note = Synthetic polynucleotide
  source 1..347: mol_type = other DNA
ggcggggcgcggtggctcacgtctttaatcccagcactttgggaggccgaggctggcagatcacctgagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatgatggaagggggagagctgtttga

SEQ ID NO: 592 - DNA, 1109 bp, synthetic construct
  misc_feature 1..1109: note = Synthetic polynucleotide
  source 1..1109: mol_type = other DNA
ggcggggcgcggtggctcacgtctttaatcccagcactttgggaggccgaggctggcagatcacctgagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtga

SEQ ID NO: 593 - DNA, 1109 bp, synthetic construct; identical to SEQ ID NO: 592
  misc_feature 1..1109: note = Synthetic polynucleotide
  source 1..1109: mol_type = other DNA

SEQ ID NO: 594 - DNA, 1109 bp, synthetic construct; identical to SEQ ID NO: 592
  misc_feature 1..1109: note = Synthetic polynucleotide
  source 1..1109: mol_type = other DNA

SEQ ID NO: 595 - DNA, 1109 bp, synthetic construct; identical to SEQ ID NO: 592
  misc_feature 1..1109: note = Synthetic polynucleotide
  source 1..1109: mol_type = other DNA

SEQ ID NO: 596 - DNA, 1109 bp, synthetic construct; identical to SEQ ID NO: 592
  misc_feature 1..1109: note = Synthetic polynucleotide
  source 1..1109: mol_type = other DNA

SEQ ID NO: 597 - DNA, 347 bp, synthetic construct; identical to SEQ ID NO: 591
  misc_feature 1..347: note = Synthetic polynucleotide
  source 1..347: mol_type = other DNA

SEQ ID NO: 598 - DNA, 1022 bp, synthetic construct; identical to SEQ ID NO: 590
  misc_feature 1..1022: note = Synthetic polynucleotide
  source 1..1022: mol_type = other DNA

SEQ ID NO: 599 - DNA, 1109 bp, synthetic construct; identical to SEQ ID NO: 592
  misc_feature 1..1109: note = Synthetic polynucleotide
  source 1..1109: mol_type = other DNA

SEQ ID NO: 600 - DNA, 269 bp, synthetic construct
  misc_feature 1..269: note = Synthetic polynucleotide
  source 1..269: mol_type = other DNA
ggcggggcgcggtggctcacgtctttaatcccagcactttgggaggccgaggctggcagatcacctgagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggca

SEQ ID NO: 601 - DNA, 85 bp, synthetic construct
  misc_feature 1..85: note = Synthetic polynucleotide
  source 1..85: mol_type = other DNA
ggcggggcgcggtggctcacgtctttaatcccagcactttgggaggccgaggctggcagatcacctgagtttttgtcttttttga

SEQ ID NO: 602 - DNA, 414 bp, synthetic construct
  misc_feature 1..414: note = Synthetic polynucleotide
  source 1..414: mol_type = other DNA
tgatatggcttggctctttgtcctcacctaaatctcatctctaattgtaatccccacgtgttgagggagggacctggtaggaggtgattagatcatgggggcggtttccctcatgctgttctcatgatagtgactgagttctcacgagatctgatggtttaaaagtgtttggcagttcacctcattgctcgctgtcttgcctccacgtgaagaaggtccttacttcccctttgccttctgccacaattgtaagtttcctgaggcctctccagccaagcagaactggaacaatggcaaaagcctttgatgaagcattttcctctgagacaacagcggcaatacctgaagaccatgaagcatctgctgagtccttttgttccatcttctttcttcctgatcttgatcgccccctga

SEQ ID NO: 603 - DNA, 434 bp, synthetic construct
  misc_feature 1..434: note = Synthetic polynucleotide
  source 1..434: mol_type = other DNA
tgatatggcttggctctttgtcctcacctaaatctcatctctaattgtaatccccacgtgttgagggagggacctggtaggaggtgattagatcatgggggcggtttccctcatgctgttctcatgatagtgactgagttctcacgagatctgatggtttaaaagtgtttggcagttcacctcattgctcgctgtcttgcctccacgtgaagaaggtccttacttcccctttgccttctgccacaattgtaagtttcctgaggcctctccagccaagcagaactggaacaatggcaaaagcctttgatgaagcattttcctctgagacaacagcggcaatacctgaagaccatgaagcatctgctgagtccttttgttccatcttctttcttcctgatcttgatcgccccctgatgcatcttcatcctgaataa

SEQ ID NO: 604 - DNA, 861 bp, synthetic construct
  misc_feature 1..861: note = Synthetic polynucleotide
  source 1..861: mol_type = other DNA
gagcgggaaccggactgggagccggagccggggcgggaaccggagctggagccgaagctggagccggcactgcggcgcacggagcggagcgctgcagccaagccgatagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggctacgaggagtgtgtggggccaggggccactcagctgtatgtccccacggacgcaccaccaccctactcgctgactgattcctgccccacgctggatggcacctccgactcaggcagcggccacagccctggccgacaccagcaggagcagaggaccccggcccaaggtggccttcacacggtctccatggacacccttcccccctacgaggctgtgtgcggggctggccccccatcaggcctgctgccactgccgggcccagacccagggccaaggggctcccagggctcacccaccccaacccgggccccagcctctggcccagagaggattgtgtga

SEQ ID NO: 605 - DNA, 56 bp, synthetic construct
  misc_feature 1..56: note = Synthetic polynucleotide
  source 1..56: mol_type = other DNA
ccccagaaagggtcttgaacttggtttcctgccctggacttaacctgccttcctga

SEQ ID NO: 606 - DNA, 763 bp, synthetic construct
  misc_feature 1..763: note = Synthetic polynucleotide
  source 1..763: mol_type = other DNA
gagcctcagtgtcctcacctgtcaagtgggcaagccatgctgatccgcagggtaagttactgggagtttgcaagacggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctga

SEQ ID NO: 607 - DNA, 763 bp, synthetic construct; identical to SEQ ID NO: 606
  misc_feature 1..763: note = Synthetic polynucleotide
  source 1..763: mol_type = other DNA

SEQ ID NO: 608 - DNA, 763 bp, synthetic construct; identical to SEQ ID NO: 606
  misc_feature 1..763: note = Synthetic polynucleotide
  source 1..763: mol_type = other DNA

SEQ ID NO: 609 - DNA, 501 bp, synthetic construct
  misc_feature 1..501: note = Synthetic polynucleotide
  source 1..501: mol_type = other DNA
gactgggcgcaggggctgatgcctgtcatcccagcactttgggtggcactggtgggcagatcacttaaggccaggagttcgagaccagtctggaacacagtgaaatcctgtctctactaaaaatacaaaaattagccaggcgtgatggcacatgtctgtaatcccagctactggggaggctgaagcacgagaatcgcttgagcctgggagatagaggttgcggagatctattgggaaactgattataaccactcgggcaccatcgatgcccacgagatgaggacagccctcaggaaggcaggtttcaccctcaacagccaggtgcagcagaccattgccctgcggtatgcgtgcagcaagctcggcatcaactttgacagcttcgtggcttgtatgatccgcctggagaccctcttcaaactattcagccttctggacgaagacaaggatggcatggttcagctctctctggccgagtggctgtgctgcgtgttggtctga

SEQ ID NO: 610 - DNA, 501 bp, synthetic construct; identical to SEQ ID NO: 609
  misc_feature 1..501: note = Synthetic polynucleotide
  source 1..501: mol_type = other DNA

SEQ ID NO: 611 - DNA, 1023 bp, synthetic construct
  misc_feature 1..1023: note = Synthetic polynucleotide
  source 1..1023: mol_type = other DNA
ggaggagccaagatggccgaataggaacagctccggtctacagctcccagcgtgagcgacgcagaagacgggtgatttctgcatttccatctgaggttaacaattcatgctgagtgtcccatgcatttggaagattttcccatggatgtgcatgcctgcccactgaagtttggaagctatgcctatacaacagctgaagtggtttattcttggactctcggaaagaacaaatccgtggaagtggcacaggatggttctcgcttgaaccagtatgaccttttgggccatgttgttgggacagagataatccggtctagtacaggagaatatgtcgtcatgacaacccacttccatctcaagcgaaaaattggctactttgtgatccagacctacttgccatgtatcatgactgtcattctgtcacaagtgtcgttctggctcaacagagagtctgttcctgcccgtacagtctttggtgtcaccactgtgcttaccatgaccaccttgagtatcagtgccagaaattccttacctaaagtggcatatgcgacggccatggactggttcatagccgtctgttatgcctttgtattttctgcactgattgaatttgccactgtcaactatttcaccaagcggagttgggcttgggaaggcaagaaggtgccagaggccctggagatgaagaagaaaacaccagcagccccagcaaagaaaaccagcactaccttcaacatcgtggggaccacctatcccatcaacctggccaaggacactgaattttccaccatctccaagggcgctgctcccagtgcctcctcaaccccaacaatcattgcttcacccaaggccacctacgtgcaggacagcccgactgagaccaagacctacaacagtgtcagcaaggttgacaaaatttcccgcatcatctttcctgtgctctttgccatattcaatctggtctattgggccacatatgtcaaccgggagtcagctatcaagggcatgatccgcaaacagtag

SEQ ID NO: 612 - DNA, 1023 bp, synthetic construct; identical to SEQ ID NO: 611
  misc_feature 1..1023: note = Synthetic polynucleotide
  source 1..1023: mol_type = other DNA

SEQ ID NO: 613 - DNA, 895 bp, synthetic construct
  misc_feature 1..895: note = Synthetic polynucleotide
  source 1..895: mol_type = other DNA
aagatgaaaaggttctggagatggatggcagtgatggttgcacaagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtga

SEQ ID NO: 614 - DNA, 247 bp, synthetic construct
  misc_feature 1..247: note = Synthetic polynucleotide
  source 1..247: mol_type = other DNA
aagatgaaaaggttctggagatggatggcagtgatggttgcacaagggctccatggagaacgagcctgtagcccttgaggaaactcagaagacagatcctgctatggaaccacggttcaaagtggtggattgggacaagagtacacggtggcagtgcccaagtccatgttccccgggctcttcatgctggggacattcctctggagcctcatcgagtacctcatccaccgcttcctgttccacatga

SEQ ID NO: 615 - DNA, 551 bp, synthetic construct
  misc_feature 1..551: note = Synthetic polynucleotide
  source 1..551: mol_type = other DNA
aagatgaaaaggttctggagatggatggcagtgatggttgcacaagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggcc

SEQ ID NO: 616 - DNA, 1269 bp, synthetic construct
  misc_feature 1..1269: note = Synthetic polynucleotide
  source 1..1269: mol_type = other DNA
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctga

SEQ ID NO: 617 - DNA, 1134 bp, synthetic construct
  misc_feature 1..1134: note = Synthetic polynucleotide
  source 1..1134: mol_type = other DNA
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 618 - DNA, 501 bp, synthetic construct
  misc_feature 1..501: note = Synthetic polynucleotide
  source 1..501: mol_type = other DNA
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcaactctga

SEQ ID NO: 619 - DNA, 1321 bp, synthetic construct
  misc_feature 1..1321: note = Synthetic polynucleotide
  source 1..1321: mol_type = other DNA
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagatctcttggaaagtctcacaggcccgcttcattatggcatctgggcccaggacaactggagcagctccacgtggcgggagcggagcacctggccgggcctcgcctcaacccagggaaccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagcc

SEQ ID NO: 620 - DNA, 1197 bp, synthetic construct
  misc_feature 1..1197: note = Synthetic polynucleotide
  source 1..1197: mol_type = other DNA
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 621 - DNA, 1203 bp, synthetic construct
  misc_feature 1..1203: note = Synthetic polynucleotide
  source 1..1203: mol_type = other DNA
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctga

SEQ ID NO: 622 - DNA, 1131 bp, synthetic construct
  misc_feature 1..1131: note = Synthetic polynucleotide
  source 1..1131: mol_type = other DNA
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 623 - DNA, 642 bp, synthetic construct
  misc_feature 1..642: note = Synthetic polynucleotide
  source 1..642: mol_type = other DNA
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctcc

SEQ ID NO: 624 - DNA, 829 bp, synthetic construct
  misc_feature 1..829: note = Synthetic polynucleotide
  source 1..829: mol_type = other DNA
gccaggcgtggtggctcacggctgtaatcccagactttcggaggcggaggcaggcagatacgaggccaggagattgagaccatcctggctaacttgcctcctgctcttcatggatgaagcagacgccttccttcggaagcgagccactgaggagataagcaaggacctcagagccacactgaacgccttcctgtaccacatgggccaacacagcaacaaattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtag

SEQ ID NO: 625 - DNA, 1257 bp, synthetic construct
  misc_feature 1..1257: note = Synthetic polynucleotide
  source 1..1257: mol_type = other DNA
ggccgggcacggtggctcacgactgtaatcccagcactttgggaggccgaggcgggcagatcacaaggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctga

SEQ ID NO: 626 - DNA, 1215 bp, synthetic construct
  misc_feature 1..1215: note = Synthetic polynucleotide
  source 1..1215: mol_type = other DNA
ggccgggcacggtggctcacgactgtaatcccagcactttgggaggccgaggcgggcagatcacaaggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctga

SEQ ID NO: 627 - DNA, 1257 bp, synthetic construct; identical to SEQ ID NO: 625
  misc_feature 1..1257: note = Synthetic polynucleotide
  source 1..1257: mol_type = other DNA

SEQ ID NO: 628 - DNA, 507 bp, synthetic construct
  misc_feature 1..507: note = Synthetic polynucleotide
  source 1..507: mol_type = other DNA
ggccgggcacggtggctcacgactgtaatcccagcactttgggaggccgaggcgggcagatcacaaggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggat

SEQ ID NO: 629 - DNA, 313 bp, synthetic construct
  misc_feature 1..313: note = Synthetic polynucleotide
  source 1..313: mol_type = other DNA
ggccgggcacggtggctcacgactgtaatcccagcactttgggaggccgaggcgggcagatcacaaggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacgg

SEQ ID NO: 630 - DNA, 291 bp, synthetic construct
  misc_feature 1..291: note = Synthetic polynucleotide
  source 1..291: mol_type = other DNA
ggccgggcacggtggctcacgactgtaatcccagcactttgggaggccgaggcgggcagatcacaaggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccatt

SEQ ID NO: 631 - DNA, 1046 bp, synthetic construct
  misc_feature 1..1046: note = Synthetic polynucleotide
  source 1..1046: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 632 - DNA, 968 bp, synthetic construct
  misc_feature 1..968: note = Synthetic polynucleotide
  source 1..968: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 633 - DNA, 1046 bp, synthetic construct; identical to SEQ ID NO: 631
  misc_feature 1..1046: note = Synthetic polynucleotide
  source 1..1046: mol_type = other DNA

SEQ ID NO: 634 - DNA, 676 bp, synthetic construct
  misc_feature 1..676: note = Synthetic polynucleotide
  source 1..676: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 635 - DNA, 494 bp, synthetic construct
  misc_feature 1..494: note = Synthetic polynucleotide
  source 1..494: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 636 - DNA, 920 bp, synthetic construct
  misc_feature 1..920: note = Synthetic polynucleotide
  source 1..920: mol_type = other DNA
gagccaagatggccgaataggaacagctccggtctacagctcccagcgtgagcgatgcagaagatgggtgatttctgcatttccatctgaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactgcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctga

SEQ ID NO: 637 - DNA, 920 bp, synthetic construct; identical to SEQ ID NO: 636
  misc_feature 1..920: note = Synthetic polynucleotide
  source 1..920: mol_type = other DNA

SEQ ID NO: 638 - DNA, 641 bp, synthetic construct
  misc_feature 1..641: note = Synthetic polynucleotide
  source 1..641: mol_type = other DNA
agccaagatggccgaacaggaacagctccggtctacacctcccagcgtgagtgacacagaagacgggtgatttctgcatttccatctgagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctga

SEQ ID NO: 639 - DNA, 2066 bp, synthetic construct
  misc_feature 1..2066: note = Synthetic polynucleotide
  source 1..2066: mol_type = other DNA
atgaagcctccataaaatcccagaaggacagggttcagtgagcttccacatagctgaacacttggactttcatggaggttggcacagccagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaa

SEQ ID NO: 640 - DNA, 2066 bp, synthetic construct; identical to SEQ ID NO: 639
  misc_feature 1..2066: note = Synthetic polynucleotide
  source 1..2066: mol_type = other DNA

SEQ ID NO: 641 - DNA, 2066 bp, synthetic construct; identical to SEQ ID NO: 639
  misc_feature 1..2066: note = Synthetic polynucleotide
  source 1..2066: mol_type = other DNA

SEQ ID NO: 642 - DNA, 2066 bp, synthetic construct; identical to SEQ ID NO: 639
  misc_feature 1..2066: note = Synthetic polynucleotide
  source 1..2066: mol_type = other DNA

SEQ ID NO: 643 - DNA, 2066 bp, synthetic construct; identical to SEQ ID NO: 639
  misc_feature 1..2066: note = Synthetic polynucleotide
  source 1..2066: mol_type = other DNA

SEQ ID NO: 644 - DNA, 2066 bp, synthetic construct; identical to SEQ ID NO: 639
  misc_feature 1..2066: note = Synthetic polynucleotide
  source 1..2066: mol_type = other DNA

SEQ ID NO: 645 - DNA, 2066 bp, synthetic construct; identical to SEQ ID NO: 639
  misc_feature 1..2066: note = Synthetic polynucleotide
  source 1..2066: mol_type = other DNA

SEQ ID NO: 646 - DNA, 476 bp, synthetic construct
  misc_feature 1..476: note = Synthetic polynucleotide
  source 1..476: mol_type = other DNA
atgaagcctccataaaatcccagaaggacagggttcagtgagcttccacatagctgaacacttggactttcatggaggttggcacagccagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagggctctataatgggatcattgcatttctctga

SEQ ID NO: 647 - DNA, 488 bp, synthetic construct
  misc_feature 1..488: note = Synthetic polynucleotide
  source 1..488: mol_type = other DNA
atgaagcctccataaaatcccagaaggacagggttcagtgagcttccacatagctgaacacttggactttcatggaggttggcacagccagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacaggatcctggatggaattgaacccatatacgttacttgacatgtga

SEQ ID NO: 648 - DNA, 1284 bp, synthetic construct
  misc_feature 1..1284: note = Synthetic polynucleotide
  source 1..1284: mol_type = other DNA
tgaagagtagcagaatatgccactttcaaacaagaataattttgagccgaagacaattaaaaagaagcatacccaagaaaaaaatccctgcccactccctttctaccaggaaaagcagaggattcttagtccttggagacaactctagatgcttatcagcccagagaaggcactagaggaatctacacaacaaactagcaagctatcttctgttagcttcccctatatatttacttcccagaatttgctgccctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccggagctgcaactggaggagagctgtgcggaggcgcaggacggggagctggacgggctgtggacgaccatcaccatcttcatcacactcttcctgttaagcgtgtgctacagtgccaccgtcaccttcttcaaggtgaagtggatcttctcctcggtggtggacctgaagcagaccatcatccccgactacaggaacatgatcggacagggggcctag

SEQ ID NO: 649 - DNA, 1077 bp, synthetic construct
  misc_feature 1..1077: note = Synthetic polynucleotide
  source 1..1077: mol_type = other DNA
tgaagagtagcagaatatgccactttcaaacaagaataattttgagccgaagacaattaaaaagaagcatacccaagaaaaaaatccctgcccactccctttctaccaggaaaagcagaggattcttagtccttggagacaactctagatgcttatcagcccagagaaggcactagaggaatctacacaacaaactagcaagctatcttctgttagcttcccctatatatttacttcccagaatttgctgccctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatga

SEQ ID NO: 650 - DNA, 972 bp, synthetic construct
  misc_feature 1..972: note = Synthetic polynucleotide
  source 1..972: mol_type = other DNA
tgaagagtagcagaatatgccactttcaaacaagaataattttgagccgaagacaattaaaaagaagcatacccaagaaaaaaatccctgcccactccctttctaccaggaaaagcagaggattcttagtccttggagacaactctagatgcttatcagcccagagaaggcactagaggaatctacacaacaaactagcaagctatcttctgttagcttcccctatatatttacttcccagaatttgctgccctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatga

SEQ ID NO: 651 - DNA, 743 bp, synthetic construct
  misc_feature 1..743: note = Synthetic polynucleotide
  source 1..743: mol_type = other DNA
gtattatatattgagttgagaaagtcaagggctttggagtcagacttcttgggtctaaactctacctctgccacttctgaactgtcaccttgggtaagtcacctgacttgtctgcacctcagtttccttatctcttacatgaagataataagaagccctacctcctaggatcactgtaaggatgacatgggaggagccatgtgaagcactcagcacagtccttggaacaagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctga

SEQ ID NO: 652 - DNA, 743 bp, synthetic construct; identical to SEQ ID NO: 651
  misc_feature 1..743: note = Synthetic polynucleotide
  source 1..743: mol_type = other DNA

SEQ ID NO: 653 - DNA, 539 bp, synthetic construct
  misc_feature 1..539: note = Synthetic polynucleotide
  source 1..539: mol_type = other DNA
gtattatatattgagttgagaaagtcaagggctttggagtcagacttcttgggtctaaactctacctctgccacttctgaactgtcaccttgggtaagtcacctgacttgtctgcacctcagtttccttatctcttacatgaagataataagaagccctacctcctaggatcactgtaaggatgacatgggaggagccatgtgaagcactcagcacagtccttggaacaagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggtgggtttctgaatcctgaggctcctgttggccatgtgaaaggaaaatga

SEQ ID NO: 654 - DNA, 1218 bp, synthetic construct
  misc_feature 1..1218: note = Synthetic polynucleotide
  source 1..1218: mol_type = other DNA
tgaagagtagcagaatatgccactttcaaacaagaataattttgagccgaagacaattaaaaagaagcatacccaagaaaaaaatccctgcccactccctttctaccaggaaaagcagaggattcttagtccttggagacaactctagatgcttatcagcccagagaaggcactagaggaatctacacaacaaactagcaagctatcttctgttagcttcccctatatatttacttcccagaatttgctgccctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatga

SEQ ID NO: 655 - DNA, 5350 bp, synthetic construct
  misc_feature 1..5350: note = Synthetic polynucleotide
  source 1..5350: mol_type = other DNA
acacccagcacccagatcttggtttctaataccattctccaataaagggaaccaggggagtctttggagaaatggctgattctaggattggggcagggggtatagcagatgagcccagagcatctggtagtgccagaaagaaaggaaaggctaaaaaaaaaatccctcattgatggggatatggcaaagggacacatgagtcaacgaaaagagctcccaatggctaaagctggaagaacttgagcaacaaaataaagtagcattggatttaatgcaaagtataaaataaatatccatgagtccatactgatataaataaatggttgaattaataatagatggagacgagataaagctcccatttagaagaattccaaataatttatgtagatactccaccctcaaggaggtggagcataactctctactccttaagtgttggctacgcatagttacttccttccaaagagtaaagtgtggaaagtaggggagaaagagtatctttacagtgaagaaatctgacgaacactatttcagccaggagatcaaggtcaaacccattagtgtacatcatgttggtagtatgtacccttgatataatttgatcagaatggcactttattacctctgtgctcttcctcccaaaagcctatcacccctgtctaactgtaagaaaaaacaatcagacacatttcagtcaagggtattctgcaaaatacctgaccagtactcctcaaaactgttaaggtcatcaaaaacaagaaaagtctgagaaactgtcacagcacagaagagcctaagaagacatgacgactaaatataatttgttatcgtggatgggatcctggaacagaaagagaacattagcacaagtcctgctcacaaatactatctggctatggaccctgtgtctgaatcactctatctatcagacaccaatactcgcaaagtctacaagttgaaatctcttgtggagacgaaagatctgtccaagaattttgaagtggtggcaggaactggtgatcagtgccttccctttgaccagagtcattgtggagatggtgggagagcatcggaagcttcactgaatagccctcgaggcatcacagttgataggcatggatttatttactttgtggatgggactatgattcgcaaaattgatgagaatgctgtgatcacaactgtaatcggctcaaatggtctgacttccacacaaccactgagctgtgactcaggaatggacatcactcaggtgcgattagagtggccaacagaccttgcagtaaatcctatggacaattcattgtatgtcttggataacaacattgtgctgcaaatttctgagaacaggcgtgttcggatcatcgcaggacgccccattcactgccaggtgccaggcatcgatcatttcctggtcagcaaggtagcaattcactccactctagagtcagcgagggccatcagtgtctcccacagcgggctgctcttcatagctgaaacagacgagaggaaagtaaaccgcattcagcaagtaaccaccaatggggagatctacatcatcgctggtgcccccactgactgtgactgcaaaattgatccaaactgtgactgtttttcaggtgatggtggctatgccaaagatgcaaagatgaaagccccttcctccttagcagtgtcgcctgatggaaccctctatgtggcagacctcggaaatgttcgaattcgtaccatcagcaggaaccaagcccacctgaatgacatgaacatttatgagattgcttcacccgctgatcaggaactgtaccagttcactgtaaatggaacccacctacacaccctgaacttgataacaagggactatgtttataacttcacctacaattctgaaggtgacttgggcgcgattaccagcagcaatggcaattcagtgcacattcgccgtgatgcaggcggaatgccgctatggcttgtggtgcctggcggacaagtatactggctgactataagcagcaatggagtcctgaaaagagtgtcagcccaaggctataatctggccttaatgacctatccaggaaacacagggcttctggctaccaaaagtaacgaaaatggatggacaaccgtttatgagtatgaccccgagggacacctgaccaatgcaacgtttcccactggagaggtcagcagcttccacagtgacctggagaagctgacaaaagtggagctagatacttccaaccgtgaaaatgtcctcatgtcaaccaacttgacggcaactagtaccatatatattttaaaacaagaaaatactcaaagtacctatcgggtgaatccagatggttccctgcgtgtcacttttgccagcgggatggagatcggcctcagctcagagccccacatcctggcaggggcagtcaaccctaccctgggcaaatgcaacatctcattgcccggagagcacaatgcaaacctcatcgagtggcggcagaggaaggagcaaaacaaaggcaatgtttcggcttttgaaaggaggctgagggcccacaacagaaacctactctccatagattttgatcatataacccgcacaggaaagatctatgatgaccatcgaaaattcacccttcgaattctttatgaccagactgggcgacccattctgtggtctcctgtaagcagatataatgaagtgaacatcacatattcaccttcgggattggtgacgtttattcaaagaggaacgtggaatgaaaaaatggaatatgaccagagtgggaaaattatttcaagaacttgggctgatgggaaaatttggagctatacctacttagaaaaatctgtgatgcttctcctacacagccagcggcgttacatctttgagtatgaccaaccagattgtctgctctcagtcaccatgcctagcatggtgcgtcacagcttacaaaccatgctttcagtgggctactaccggaacatctacaccccaccggacagtagcacttcttttatccaagactatagtcgagatggccgattgctacagaccctgcatctggggacagggcgcagagtcttatacaagtacaccaagcaagcaaggctttctgaggttctctatgataccactcaggtcacattaacatatgaagagtcttctggagtgattaagacaatacacctgatgcatgacggattcatctgcacaatcagatacaggcaaacaggacctcttattggacgccagattttcagattcagtgaagaaggccttgtgaatgcacggttcgactacagctacaacaatttccgagtcacaagcatgcaagctgtaatcaatgaaacccctttgcctatagatctttaccgatatgttgatgtctctggcagaacagagcagtttggaaaattcagtgtaattaattacgatttaaatcaggtcataactactacagtgatgaaacacaccaaaatcttcagtgccaatggacaagtcattgaagtccaatatgaaatcctaaaggcaattgcctactggatgaccattcaatatgataatgtgggccgcatggtaatatgtgacataagggtaggagtagatgccaatataacaaggtacttctatgaatacgatgctgatgggcaacttcagactgtttctgtaaatgacaaaacccagtggcgttatagttacgatctgaatggaaacatcaacctcttaagccatgggaagagtgctcgtcttactcctctccgatatgacctccgagaccgcatcaccagattaggagaaattcagtataaaatggatgaagatggctttctgaggcagaggggaaatgatatttttgaatataattctaatggcctgctgcagaaagcctacaataaggcttctggctggactgtgcagtattactatgatgggcttgggcgacgtgtcgcgagtaagtccagcctagggcagcaccttcagttcttttatgcagaccttaccaaccccataagagttactcatttgtacaaccacacaagctcggagattacatctctgtattatgatctccaaggtcaccttattgccatggagttaagcagtggtgaagaatattatgtagcctgtgataatacaggtaccccactagctgtgttcagcagccgaggtcaggtcataaaggagatactatacacaccttatggcgatatctatcatgacacttaccctgactttcaggtcattattggttttcatggaggactctatgatttccttactaaattagtgcacctggggcaaagggattatgatgttgttgctggcagatggacaacgcctaatcatcacatatggaaacagttgaacctccttcctaaaccattcaacctctactcctttgaaaataactacccagttggcaaaattcaagatgttgcaaagtataccacagacatcagaagttggttggagctatttggtttccaattacacaatgtactacctggatttcccaaacctgaattagaaaatttagaattaacttacgagcttctacggcttcagacaaaaactcaagagtgggatcctggaaagactatcctgggcattcagtgtgaactccagaaacagctcaggaatttcatttccttggaccaactacctatgactccccgatacaatgatggacggtgccttgaaggagggaagcaaccaaggtttgctgctgtcccttctgtttttgggaaaggtataaaatttgccatcaaggatggcatagtaacagctgatattataggagtagccaatgaagatagcaggcggcttgctgccattctcaataatgcccattacctggaaaacctacattttaccatagaggggagggacactcactacttcattaagcttgggtctctggaggaagacctggtgctcatcggtaacactggggggaggcggattctggagaatggtgtcaatgtcactgtgtcccagatgacttctgtgttgaatgggaggactagacggtttgcagatattcagctccagcatggagccctgtgcttcaacatccggtatgggacaactgtcgaagaggaaaagaatcacgtgttggagattgccagacagcgcgcagtggcccaggcctggactaaggaacaaagaaggctgcaagagggggaagaggggattagggcatggacagaaggggaaaagcagcagcttttgagcactgggcgggtacaaggttacgatgggtattttgttttgtctgttgagcagtatttagaactttctgacagtgccaataatattcactttatgagacagagcgaaataggcaggaggtaa

SEQ ID NO: 656 - DNA, 5350 bp, synthetic construct; identical to SEQ ID NO: 655
  misc_feature 1..5350: note = Synthetic polynucleotide
  source 1..5350: mol_type = other DNA

SEQ ID NO: 657 - DNA, 1397 bp, synthetic construct
  misc_feature 1..1397: note = Synthetic polynucleotide
  source 1..1397: mol_type = other DNA
acctggaaagtcatccttgtgtcttcccctttatttcaccattcatgtcctgtctatcaacagtccttccaccagtatctctaaaatatctcctgaatcagcccacttccttccatcttcactacatgcaccctggccttccaagctactatcggctctcaaccagactgctgggaccacctgatctctctgcttccactctgtctcaacccccatctattttccaagcagcactagagttatcatattaaaatgtaaatatcagttttttttttaaagaaaaaaaccctgagacttaacagagttataaaaaatataaatgtcatcatcagttccctgcttaaaacccttaactcgcttccaattgcacttggaatgaaaccaaactgcactgatccagcccttgcctgcctccccaaagtccaaggggtcatggctctttccctggctacactggttttctttctgtccctcaacactgcaagcctattgctgccccagggcctttacacttgctttttttctgcctagaacagttcttccccaaagatttttaaagggccgggctccttaacattgaagtcgcagaccaaacgccacatatgcagacagttcttctctaactactttaaaatagccctctgtccattcattcttcatcacattaacctgtttaattttcttctcagagctccacactatttggaagtatttgttgacttgttaccatgtctccccactagagtcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaa

SEQ ID NO: 658 - DNA, 701 bp, synthetic construct
  misc_feature 1..701: note = Synthetic polynucleotide
  source 1..701: mol_type = other DNA
tggataggcagccctttgacctcacccctccacttcagccagagcagcttccttttagctgtttgattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaggaggaggatgaagaggaagaggctaccaaggaagatgctgaggccccaggcatcagagatcatgagagcctgtag

SEQ ID NO: 659 - DNA, 701 bp, synthetic construct; identical to SEQ ID NO: 658
  misc_feature 1..701: note = Synthetic polynucleotide
  source 1..701: mol_type = other DNA

SEQ ID NO: 660 - DNA, 701 bp, synthetic construct; identical to SEQ ID NO: 658
  misc_feature 1..701: note = Synthetic polynucleotide
  source 1..701: mol_type = other DNA

SEQ ID NO: 661 - DNA, 701 bp, synthetic construct; identical to SEQ ID NO: 658
  misc_feature 1..701: note = Synthetic polynucleotide
  source 1..701: mol_type = other DNA

SEQ ID NO: 662 - DNA, 861 bp, synthetic construct
  misc_feature 1..861: note = Synthetic polynucleotide
  source 1..861: mol_type = other DNA
gacatctccagtatgtctacacttgttttcatccaactgtcaacttgacacctatacttaagatgtttgatgggcatctcactattaacttggccaacacagaagtttctaatttcctacatcaccaacttaatcttcacaatgtttctgtagatcagtgaagggaacttgccttcctccaagttgcttaatagtgacaaaaaaatttaggagaaaattcttcatcctcagcacgttatcctgactctatccgcaacctgtatctgggatctattcaccattctcaccattctccattctttctgaaaatttctaagtttaaaccaccatattctcattagactctcaagagtttccagtggtgtctgcctgtttcctgttaggtctcctttaaagccattatttaacagcagataatcgaaaagtatagatcatgtaatgttctactcctgtttaaaactctgtggtgacttcccattacagttagaataaggttcagacttcttaaaatggtccacaaatgtttctctgacctgtcctttgccttgttgcagacaactgtggcccctctcccgcctccttcaccgccccacagctctgctggccttcttttctaccttgaacatgccaagctctgttaccatctatgatttttttcatattctacaacatctaccgtcttcatatttgcctttatctctgtctaggatgccccttctagatgttcatggctcactccctgccatgttgtcaggtatttgagctctctgttcccactcagagtagatgagcagaagaggaaatgagggccttcccagagcaactcccccagaaaattcacaagaagagaggaaatactga

SEQ ID NO: 663 - DNA, 861 bp, synthetic construct; identical to SEQ ID NO: 662
  misc_feature 1..861: note = Synthetic polynucleotide
  source 1..861: mol_type = other DNA

SEQ ID NO: 664 - DNA, 2429 bp, synthetic construct
  misc_feature 1..2429: note = Synthetic polynucleotide
  source 1..2429: mol_type = other DNA
ttgcctgatctgcatacatgtcaccaccttacagaatgacaaagtcagaaagagggaaagggctttccagccacaacgagctgctggcctcctgcgggaagaagttctgcagccgagggagccggtgcgtgctcagcaggaagacaggggagcccgaatgccagtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactccagacccgtctgcagccactccaagaaggagacagcagacaagaccctgcctcccagaagcgcctcctggtggaatctctgttcagggacttagatgcagatggcaatggccacctcagcagctccgaactggctcagcatgtgctgaagaagcaggacctggatgaagacttacttggttgctcaccaggtgacctcctccgatttgacgattacaacagtgacagctccctgaccctccgcgagttctacatggccttccaagtggttcagctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatga

SEQ ID NO: 665 - DNA, 365 bp, synthetic construct
  misc_feature 1..365: note = Synthetic polynucleotide
  source 1..365: mol_type = other DNA
ttgcctgatctgcatacatgtcaccaccttacagaatgacaaagtcagaaagagggaaagggctttccagccacaacgagctgctggcctcctgcgggaagaagttctgcagccgagggagccggtgcgtgctcagcaggaagacaggggagcccgaatgccagtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactc

SEQ ID NO: 666 - DNA, 136 bp, synthetic construct
  misc_feature 1..136: note = Synthetic polynucleotide
  source 1..136: mol_type = other DNA
ttggtcgctgtggcacccactgaataaaaggagactcagtggcagtggatctgggacagatttcactctcaccatcagctgcctgcagtctgaagattttgcaacttattactgtcaacagtattatagttaccct

SEQ ID NO: 667 - DNA, 1014 bp, synthetic construct
  misc_feature 1..1014: note = Synthetic polynucleotide
  source 1..1014: mol_type = other DNA
tgtggggaaaagcaagagggatcagattgttactgtgtctgtgtagaaagaagtagacataggagactccattttgttctgcactaagaaaaattcttctgccttgagatgctgttaatctatgaccttacccccaacaccgtgctctctgaaacatgtgctgtgtcgaactcagggttaaatggattaagggttgtgcaagatgtgctttgttaaacagatgcttgaaggcagcatgctccttaagagtcatcaccactccctaatctcaagtacccagggacacaaacactgcggaaggctgcagggacctctgcctaggaaagccagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccaccagcaggactcctgcactga

SEQ ID NO: 668 - DNA, 1158 bp, synthetic construct
  misc_feature 1..1158: note = Synthetic polynucleotide
  source 1..1158: mol_type = other DNA
tgtggggaaaagcaagagggatcagattgttactgtgtctgtgtagaaagaagtagacataggagactccattttgttctgcactaagaaaaattcttctgccttgagatgctgttaatctatgaccttacccccaacaccgtgctctctgaaacatgtgctgtgtcgaactcagggttaaatggattaagggttgtgcaagatgtgctttgttaaacagatgcttgaaggcagcatgctccttaagagtcatcaccactccctaatctcaagtacccagggacacaaacactgcggaaggctgcagggacctctgcctaggaaagccagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgagtggcattggaggcttcgtgctggggctgatcttcctcgggctgggccttatcatccgtcacaggggtcagaaaggacctcgagggcctccaccagcaggtaatatttcagccatgatccagtcaggggagagggcacaggcataa

SEQ ID NO: 669 - DNA, 1125 bp, synthetic construct
  misc_feature 1..1125: note = Synthetic polynucleotide
  source 1..1125: mol_type = other DNA
tgtggggaaaagcaagagggatcagattgttactgtgtctgtgtagaaagaagtagacataggagactccattttgttctgcactaagaaaaattcttctgccttgagatgctgttaatctatgaccttacccccaacaccgtgctctctgaaacatgtgctgtgtcgaactcagggttaaatggattaagggttgtgcaagatgtgctttgttaaacagatgcttgaaggcagcatgctccttaagagtcatcaccactccctaatctcaagtacccagggacacaaacactgcggaaggctgcagggacctctgcctaggaaagccagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgagtggcattggaggcttcgtgctggggctgatcttcctcgggctgggccttatcatccgtcacaggggtcagaaaggacctcgagggcctccaccagcaggactcctgcactga

SEQ ID NO: 670 - DNA, 1694 bp, synthetic construct
  misc_feature 1..1694: note = Synthetic polynucleotide
  source 1..1694: mol_type = other DNA
tgtggaggaaaagctaaatatcaaatttgaactcaactgaacatggacacaaacaatggtcaccaagtcctggaacaggttgtgtaagccccttgaggcattcatccaacactgtttcagagaaatctctactttgatctattcctatatattagttattgaaaaataacagacgattacaaaaacaagttgacctttttgtgttccttgagcccagtgtgaagggccctcttgactgggcctcatgccaaacaacttgttacaaaaagagctagggtcccagactacgtcaaagcttcatgagacctctcctcatctgtgcacggacaagtggctgactctggagcccaggctgttgcttcctggcctggtggtgaatcctccatagtctggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagattgtgagcaagctaataaactgggagcaattaacagcacattaagtaatcaaagcaaagaagctttcattgactgggcaagatatgatgattcacgggatcacttttgtgaacttgatgatgagagatctccagctgctcagtatgtagacctattgctgaacccagagcgttacactggctataaagggacctctgcatggagagtgtggaacagcatctatgaagagaactgtttcaagcctcgatctgtttatcgtcctttaaatcctctggcgcctagccgaggcgaagatgatggagaatcattctacacatggctagaaggtttgtgtctggagaaaagagtcttctataagcttatatcgggacttcatgctagcatcaatttacatctatgcgcaaattatcttttggaagaaacctggggtaagcccagttggggacctaatattaaagaattcaaacaccgctttgaccctgtggaaaccaagggagaaggtccaagaaggctcaagaatctttactttttatacttgattgagcttcgagctttgtcaaaggtggctccatattttgagcgctcaattgtcgatctttacactggaaatgcagaagaagatgctgacacaaaaactcttctactgaatatctttcaagatacaaagtcctttcccatgcactttgatgagaaatccatgtttgcaggtgacaaaaaaggggccaagtcactaaaggaggaattccgattacatttcaagaatatctcccgtataatggactgtgttggatgtgacaaatgcagattatggggaaaattacagactcagggtttaggaactgccctgaagatattattctctgaaaaagaaatccaaaagcttccagagaatagtccatctaaaggcttccaactcacccgacaggaaatagttgctcttttaaatgcttttggaaggctttctacaagtataagagacttacagaattttaaagtcttattacaacacagtaggtaa

SEQ ID NO: 671 - DNA, 725 bp, synthetic construct
  misc_feature 1..725: note = Synthetic polynucleotide
  source 1..725: mol_type = other DNA
tgtggaggaaaagctaaatatcaaatttgaactcaactgaacatggacacaaacaatggtcaccaagtcctggaacaggttgtgtaagccccttgaggcattcatccaacactgtttcagagaaatctctactttgatctattcctatatattagttattgaaaaataacagacgattacaaaaacaagttgacctttttgtgttccttgagcccagtgtgaagggccctcttgactgggcctcatgccaaacaacttgttacaaaaagagctagggtcccagactacgtcaaagcttcatgagacctctcctcatctgtgcacggacaagtggctgactctggagcccaggctgttgcttcctggcctggtggtgaatcctccatagtctggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagattgtgagcaagctaataaactgggagcaattaacagcacattaagatga

SEQ ID NO: 672 - DNA, 611 bp, synthetic construct
  misc_feature 1..611: note = Synthetic polynucleotide
  source 1..611: mol_type = other DNA
tgtggggaaaagcaagagagatcagattgttactgtgtctgtgtagaaagaagtagacataggagactccattttgttatgtactaagaaaaatccttctgccttgagattctgttaatctataaccttacccccaaccccgtgctctctgaaacatgtgctgtgtcaactcagagttgaatggattaacggcggtgcaagatgtgctttgttaaacagatgcttgaaggcagcatgctccttaagagtcatcaccactccctaatctcaagtacccagggacacaaaaactgcggaaggccgcagggacctctgcctaggaaagccagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactga

SEQ ID NO: 673 - DNA, 464 bp, synthetic construct
  misc_feature 1..464: note = Synthetic polynucleotide
  source 1..464: mol_type = other DNA
tgtggggaaaagcaagagagatcagattgttactgtgtctgtgtagaaagaagtagacataggagactccattttgttatgtactaagaaaaatccttctgccttgagattctgttaatctataaccttacccccaaccccgtgctctctgaaacatgtgctgtgtcaactcagagttgaatggattaacggcggtgcaagatgtgctttgttaaacagatgcttgaaggcagcatgctccttaagagtcatcaccactccctaatctcaagtacccagggacacaaaaactgcggaaggccgcagggacctctgcctaggaaagccagtgggtaattccagaattgattggccataccattgtcactgtattactgctcatgtcattgcactggttcatcttccttctcaacttacctgttgccacttggaatatatatcgtggtagcaactgcccttgctaa

SEQ ID NO: 674 - DNA, 470 bp, synthetic construct
  misc_feature 1..470: note = Synthetic polynucleotide
  source 1..470: mol_type = other DNA
tgtggggaaaagcaagagagatcagattgttactgtgtctgtgtagaaagaagtagacataggagactccattttgttatgtactaagaaaaatccttctgccttgagattctgttaatctataaccttacccccaaccccgtgctctctgaaacatgtgctgtgtcaactcagagttgaatggattaacggcggtgcaagatgtgctttgttaaacagatgcttgaaggcagcatgctccttaagagtcatcaccactccctaatctcaagtacccagggacacaaaaactgcggaaggccgcagggacctctgcctaggaaagccagtgggtaattccagaattgattggccataccattgtcactgtattactgctcatgtcattgcactggttcatcttccttctcaacttacctgttgccacttggaatatatatcgtatgatcttagctttgataaatgactga

SEQ ID NO: 675 - DNA, 605 bp, synthetic construct
  misc_feature 1..605: note = Synthetic polynucleotide
  source 1..605: mol_type = other DNA
tgtggggaaaagcaagagagatcagattgttactgtgtctgtgtagaaagaagtagacataggagactccattttgttatgtactaagaaaaatccttctgccttgagattctgttaatctataaccttacccccaaccccgtgctctctgaaacatgtgctgtgtcaactcagagttgaatggattaacggcggtgcaagatgtgctttgttaaacagatgcttgaaggcagcatgctccttaagagtcatcaccactccctaatctcaagtacccagggacacaaaaactgcggaaggccgcagggacctctgcctaggaaagccagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtggtagcaactgcccttgctaa

SEQ ID NO: 676 - DNA, 1234 bp, synthetic construct
  misc_feature 1..1234: note = Synthetic polynucleotide
  source 1..1234: mol_type = other DNA
tacactgaaattcatagtaacattgttcacaatagccaaaaggagagaacaacccaaatgttcatcaaaaataaaatgtggtatatccatacaatggaatattatgcagccataaaatggaatgaaattttcatgtacactgtaacatgaatgtaccatgaaaacattatgcttactgaaataatccagataaataaagacaaatactgtatgattccacatatatgaggcatctaaagtagccaaatttatagaaacggaaaatagaatggcagttgccaggggctgagggaagaagaaaaacataagtgtttattgtgtataaagttttaattttataagatgaaaaggttctggagatggatggcagtgatggttgcacaagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtga

SEQ ID NO: 677 - DNA, 586 bp, synthetic construct
  misc_feature 1..586: note = Synthetic polynucleotide
  source 1..586: mol_type = other DNA
tacactgaaattcatagtaacattgttcacaatagccaaaaggagagaacaacccaaatgttcatcaaaaataaaatgtggtatatccatacaatggaatattatgcagccataaaatggaatgaaattttcatgtacactgtaacatgaatgtaccatgaaaacattatgcttactgaaataatccagataaataaagacaaatactgtatgattccacatatatgaggcatctaaagtagccaaatttatagaaacggaaaatagaatggcagttgccaggggctgagggaagaagaaaaacataagtgtttattgtgtataaagttttaattttataagatgaaaaggttctggagatggatggcagtgatggttgcacaagggctccatggagaacgagcctgtagcccttgaggaaactcagaagacagatcctgctatggaaccacggttcaaagtggtggattgggacaagagtacacggtggcagtgcccaagtccatgttccccgggctcttcatgctggggacattcctctggagcctcatcgagtacctcatccaccgcttcctgttccacatga

SEQ ID NO: 678 - DNA, 890 bp, synthetic construct
  misc_feature 1..890: note = Synthetic polynucleotide
  source 1..890: mol_type = other DNA
tacactgaaattcatagtaacattgttcacaatagccaaaaggagagaacaacccaaatgttcatcaaaaataaaatgtggtatatccatacaatggaatattatgcagccataaaatggaatgaaattttcatgtacactgtaacatgaatgtaccatgaaaacattatgcttactgaaataatccagataaataaagacaaatactgtatgattccacatatatgaggcatctaaagtagccaaatttatagaaacggaaaatagaatggcagttgccaggggctgagggaagaagaaaaacataagtgtttattgtgtataaagttttaattttataagatgaaaaggttctggagatggatggcagtgatggttgcacaagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggcc

SEQ ID NO: 679 - DNA, 515 bp, synthetic construct
  misc_feature 1..515: note = Synthetic polynucleotide
  source 1..515: mol_type = other DNA
tgataaggttagcctttgtgtccccacccaaatctcatcttgaaatgtaatccccaggtgttgagggagagaccttgtgggaggtgattggatcatgggggcagtttccccatgctgttcttgtgatagcgagtgagttcccaggacatctgatgtatttataagtgtttgatagttcctctcttgcttgcttcttctctctcctgccatcctgtgaagaggtgccttctgtcatgattcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactga

SEQ ID NO: 680 - DNA, 407 bp, synthetic construct
  misc_feature 1..407: note = Synthetic polynucleotide
  source 1..407: mol_type = other DNA
tgataaggttagcctttgtgtccccacccaaatctcatcttgaaatgtaatccccaggtgttgagggagagaccttgtgggaggtgattggatcatgggggcagtttccccatgctgttcttgtgatagcgagtgagttcccaggacatctgatgtatttataagtgtttgatagttcctctcttgcttgcttcttctctctcctgccatcctgtgaagaggtgccttctgtcatgattcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaccttaa

SEQ ID NO: 681 - DNA, 485 bp, synthetic construct
  misc_feature 1..485: note = Synthetic polynucleotide
  source 1..485: mol_type = other DNA
tgataaggttagcctttgtgtccccacccaaatctcatcttgaaatgtaatccccaggtgttgagggagagaccttgtgggaggtgattggatcatgggggcagtttccccatgctgttcttgtgatagcgagtgagttcccaggacatctgatgtatttataagtgtttgatagttcctctcttgcttgcttcttctctctcctgccatcctgtgaagaggtgccttctgtcatgattcatcctggtggggaagaagttttaagggaacaagctggaggtgacgctactgagaactttgaggatgtcgggcactctacagatgccagggaaatgtccaaaacattcatcattggggagctccatccagaaactcttatcactactattgattctagttccagttggtggaccaactgggtgatccctgccatctctgcagtggccgtcgccttgatgtatcgcctatacatggcagaggactga

SEQ ID NO: 682 - DNA, 380 bp, synthetic construct
  misc_feature 1..380: note = Synthetic polynucleotide
  source 1..380: mol_type = other DNA
actggacctggaatctggcttggtcttggaatctgggctctaccaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggtaggggctgatgcttaa

SEQ ID NO: 683 - DNA, 422 bp, synthetic construct
  misc_feature 1..422: note = Synthetic polynucleotide
  source 1..422: mol_type = other DNA
actggacctggaatctggcttggtcttggaatctgggctctaccaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtga

SEQ ID NO: 684 - DNA, 271 bp, synthetic construct
  misc_feature 1..271: note = Synthetic polynucleotide
  source 1..271: mol_type = other DNA
actggacctggaatctggcttggtcttggaatctgggctctaccaggtcacttttcaataggatggactttgaagacttggggttggtagtagattgggaccaccacctgcctccaccagctgccaagactgtggttgagaacctccccaggacagtcatcagaggctctcaggctgttttccaggtcaggtgggggcaagtgtccttcaggagtgggagcttgggaggcagagcctgtagcagctctcctgatcagcactccttcctaaa

SEQ ID NO: 685 - DNA, 197 bp, synthetic construct
  misc_feature 1..197: note = Synthetic polynucleotide
  source 1..197: mol_type = other DNA
actggacctggaatctggcttggtcttggaatctgggctctaccaggtcacttttcaataggatggactttgaagacttggggttggtagtagattgggaccaccacctgcctccaccagctgccaagactgtggttgagaacctccccaggacagtcatcagaggctctcaggctggaggaggagactgccattga

SEQ ID NO: 686 - DNA, 524 bp, synthetic construct
  misc_feature 1..524: note = Synthetic polynucleotide
  source 1..524: mol_type = other DNA
actggacctggaatctggcttggtcttggaatctgggctctaccaggtcacttttcaataggatggactttgaagacttggggttggtagtagattgggaccaccacctgcctccaccagctgccaagactgtggttgagaacctccccaggacagtcatcagaggctctcaggctgctctcaccgtgccctgggcccagtactcaagcttctttctgttcatggactgctgggggatggaagaagagtggcagttgggagcaggggagggtggttatcagcttatgaagatcagaccaaggctagaacactactctacttttctcagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaa

SEQ ID NO: 687 - DNA, 2194 bp, synthetic construct
  misc_feature 1..2194: note = Synthetic polynucleotide
  source 1..2194: mol_type = other DNA
atatggtttggctgtgtcccaacccaaatctcaacttgagttgtatctcccagaattcccacatgtgggagggacccagggggaggtaatcaaatcatgggggctggtttttcctgtgctattctcatgatagtgaataagtctcacaagatcttatgggtttataaggggtttccgcttttgcttcctcctcatttctctcttgctgcaaccatgtaagaagtgccttccaccctctgccatgattgtgagatcttccccagccatgtggaactgaatgggaagatacagtgcagtcggaagtgttactgagagaattttcacattatactatgatcacttgggattcctacataagctgactctgggtcgctttgaagctagtggaccacccacagcctttggaaattctagaaatctttttggacagcctccagatatgggctttgagactgcgcttgccccacagcacacctccttagatgaaattatcttttttgcatatgtacctgagaacgaaccccaggaaacgatctacagcaagaagttcggcaatatacactatggaaaagtgatacactctgggaaaactggaagagcttacataagaaaggtattgcaacatacgactcctaaaggatttttgtcctcagttattgcagaaatgaaagagccctttggattagaagaagtgaatgagagctcttgtttgtctagttcccttttgattaataaagctggaaatgtctataaactcactcttgattcacaagttgttcaggccttgtttgaagatacagatatagagaagactgtagtgcttcccgggtacagcagcttcctcatcacaagcattttagataataagaatgcattagccattgctaccatgcctgaaagtgcacccaacaatatgacctttctaaagagcacatggttcttatacaactttgggcaaaggaatggacgaacatggaaaatatattcaaaaccatgtaattattggtttcaacatgatgattcaccatccctcaacatcgtgaaatacattgatctgggaaactcttatgttttaaaagctaaggtcatacggaatgcaaaaggttttcgaatgcttgaaataccactactgactgtgtttgttggaaaccctaatttgttggaagttacagctgaagtgacttttgatgatactgacagttatgtaataacaatttctgcagctagcaaagttttacatcagggttcaacttcactggcatttattatgtggtcagcctctactgagtgctttgttacgacaatggtgccaacactgaaaagcagctgtagttatctcagatctatgcatcacattcctagcaaatttatcccatttgaagactggattagtggagttcataaagacagtcagggttttaacctcatcaaaactttgccgataaactacaggcctccatctaatatgggaattgctattccactcacagataatttttatcatgcagatcctagcaaacccataccaagaaacatgtttcacatgtcaaagaaaaccggtaaattcaaacagtgtgctaatgtttccactcgggaggagtgtaactgcacaaaggatcagaagttttcacatgctgttgctttctcggattgcagggaaaaagttcctcgctttaagtttccaattacacaatatccagtttctttggaaattatcaacgaggatggacgtgtcccattgcaatctccatatctggttactgtgactgaagtgaacatgaggcacaactggaaactgaaacacactgtgccagaaaatattaaaagaatgaaacaattagtagaaccaattcttggtgctgcagtgtataatccttcaggtctcaacttaagcataaagggctctgaacttttccactttagagtgaccgtcatttcaggagtaactttttgtaacttaattgaagaatttcagatttatgttgatgaggcaccattgccattcccaggacacacgcttattgccgtggcaacagcggtagtgctagggggattaatttttatagcatttatgtttcaactgcaaggcatccatccgtggaggacattccaaagatggattagaagaaaccaagagaagttttcaagtatctctctcagtgagctgattcatagatcaaagtctgaagagtga

SEQ ID NO: 688 - DNA, 362 bp, synthetic construct
  misc_feature 1..362: note = Synthetic polynucleotide
  source 1..362: mol_type = other DNA
atatggtttggctgtgtcccaacccaaatctcaacttgagttgtatctcccagaattcccacatgtgggagggacccagggggaggtaatcaaatcatgggggctggtttttcctgtgctattctcatgatagtgaataagtctcacaagatcttatgggtttataaggggtttccgcttttgcttcctcctcatttctctcttgctgcaaccatgtaagaagtgccttccaccctctgccatgattgtgagatcttccccagccatgtggaactgaatgggaagatacagtgcagtcggaagtgttactgagagaattttcacattatactatgatcacttgggattcctacataagctga

SEQ ID NO: 689 - DNA, 781 bp, synthetic construct
  misc_feature 1..781: note = Synthetic polynucleotide
  source 1..781: mol_type = other DNA
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaa

SEQ ID NO: 690 - DNA, 844 bp, synthetic construct
  misc_feature 1..844: note = Synthetic polynucleotide
  source 1..844: mol_type = other DNA
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaa

SEQ ID NO: 691 - DNA, 781 bp, synthetic construct; identical to SEQ ID NO: 689
  misc_feature 1..781: note = Synthetic polynucleotide
  source 1..781: mol_type = other DNA

SEQ ID NO: 692 - DNA, 701 bp, synthetic construct
  misc_feature 1..701: note = Synthetic polynucleotide
  source 1..701: mol_type = other DNA
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagaccc

SEQ ID NO: 693 - DNA, 812 bp, synthetic construct
  misc_feature 1..812: note = Synthetic polynucleotide
  source 1..812: mol_type = other DNA
gggaaatagcttactatgagtctcaggagtcttccctgtgaaacctggcagtaccgcatgcctcccagagctgtacaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtag

SEQ ID NO: 694 - DNA, 752 bp, synthetic construct
  misc_feature 1..752: note = Synthetic polynucleotide
  source 1..752: mol_type = other DNA
gggaaatagcttactatgagtctcaggagtcttccctgtgaaacctggcagtaccgcatgcctcccagagctgtacaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtag

SEQ ID NO: 695 - DNA, 1718 bp, synthetic construct
  misc_feature 1..1718: note = Synthetic polynucleotide
  source 1..1718: mol_type = other DNA
cagtacaggacagtgattaaacgcgtcgaccacattgcctgggtttgaatcctgccgctgcttttgagtagctccttgagcttggacaagtttcttagcttttctgtacctgtttccctgtctaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagagtttttttcatttatttga

SEQ ID NO: 696 - DNA, 1769 bp, synthetic construct
  misc_feature 1..1769: note = Synthetic polynucleotide
  source 1..1769: mol_type = other DNA
cagtacaggacagtgattaaacgcgtcgaccacattgcctgggtttgaatcctgccgctgcttttgagtagctccttgagcttggacaagtttcttagcttttctgtacctgtttccctgtctaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaa

SEQ ID NO: 697 - DNA, 1763 bp, synthetic construct
  misc_feature 1..1763: note = Synthetic polynucleotide
  source 1..1763: mol_type = other DNA
cagtacaggacagtgattaaacgcgtcgaccacattgcctgggtttgaatcctgccgctgcttttgagtagctccttgagcttggacaagtttcttagcttttctgtacctgtttccctgtctaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctga

SEQ ID NO: 698 - DNA, 1769 bp, synthetic construct; identical to SEQ ID NO: 696
  misc_feature 1..1769: note = Synthetic polynucleotide
  source 1..1769: mol_type = other DNA

SEQ ID NO: 699 - DNA, 1763 bp, synthetic construct; identical to SEQ ID NO: 697
  misc_feature 1..1763: note = Synthetic polynucleotide
  source 1..1763: mol_type = other DNA

SEQ ID NO: 700 - DNA, 1763 bp, synthetic construct; identical to SEQ ID NO: 697
  misc_feature 1..1763: note = Synthetic polynucleotide
  source 1..1763: mol_type = other DNA

SEQ ID NO: 701 - DNA, 394 bp, synthetic construct
  misc_feature 1..394: note = Synthetic polynucleotide
  source 1..394: mol_type = other DNA
gcttttcacggttttagttacccacggtcagctgtggtccaaaaatatgcagtggaaaattcccaaaacaaacaatttatgaatttaatatttgctccattctgagtagtgtgatgaaatctcatgccgtccagctctgtctcacccaggatgtgaatcatccctttgtctagtgtatccaggttgtataggatacctgcgttagtcagaacttagtagccatcttggtgataagattgaccgtctcagtattgcagtgcttgtgttcaagtcgttgaggacttccacatggagattggcacaggaccagactcaagacacacaactcataacagttgatgaaaaattggcatttggagttcctgttcactctacctggatgcattttaactaa

SEQ ID NO: 702 - DNA, 700 bp, synthetic construct
  misc_feature 1..700: note = Synthetic polynucleotide
  source 1..700: mol_type = other DNA
gcttttcacggttttagttacccacggtcagctgtggtccaaaaatatgcagtggaaaattcccaaaacaaacaatttatgaatttaatatttgctccattctgagtagtgtgatgaaatctcatgccgtccagctctgtctcacccaggatgtgaatcatccctttgtctagtgtatccaggttgtataggatacctgcgttagtcagaacttagtagccatcttggtgataagattgaccgtctcagtattgcagtgcttgtgttcaagtcgttgaggacttccacatggagattggcacaggaccagactcaagacacacaactcataacagttgatgaaaaattggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaatag

SEQ ID NO: 703 - DNA, 568 bp, synthetic construct
  misc_feature 1..568: note = Synthetic polynucleotide
  source 1..568: mol_type = other DNA
gcttttcacggttttagttacccacggtcagctgtggtccaaaaatatgcagtggaaaattcccaaaacaaacaatttatgaatttaatatttgctccattctgagtagtgtgatgaaatctcatgccgtccagctctgtctcacccaggatgtgaatcatccctttgtctagtgtatccaggttgtataggatacctgcgttagtcagaacttagtagccatcttggtgataagattgaccgtctcagtattgcagtgcttgtgttcaagtcgttgaggacttccacatggagattggcacaggaccagactcaagacacacaactcataacagttgatgaaaaattggtttatcttgtaccactgtgttttacattctgtggtctagccacaccaagcctggaacttgctactctttttcctgcttcaaggcatttggagttcctgttcactctacctggatgcattttaactaatcctgaggacttcatccggtcaccatctacctattcttcaaatggatatcactactttaactggagttccagaagagcatataaaaactag

SEQ ID NO: 704 - DNA, 535 bp, synthetic construct
  misc_feature 1..535: note = Synthetic polynucleotide
  source 1..535: mol_type = other DNA
gcttttcacggttttagttacccacggtcagctgtggtccaaaaatatgcagtggaaaattcccaaaacaaacaatttatgaatttaatatttgctccattctgagtagtgtgatgaaatctcatgccgtccagctctgtctcacccaggatgtgaatcatccctttgtctagtgtatccaggttgtataggatacctgcgttagtcagaacttagtagccatcttggtgataagattgaccgtctcagtattgcagtgcttgtgttcaagtcgttgaggacttccacatggagattggcacaggaccagactcaagacacacaactcataacagttgatgaaaaattggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacgatggagctatga

SEQ ID NO: 705 - DNA, 129 bp, synthetic construct
  misc_feature 1..129: note = Synthetic polynucleotide
  source 1..129: mol_type = other DNA
ttcaagtcgttgaggacttccacatggagattggcacaggaccagactcaagacacacaactcataacagttgatgaaaaattggcatttggagttcctgttcactctacctggatgcattttaactaa

SEQ ID NO: 706 - DNA, 435 bp, synthetic construct
  misc_feature 1..435: note = Synthetic polynucleotide
  source 1..435: mol_type = other DNA
ttcaagtcgttgaggacttccacatggagattggcacaggaccagactcaagacacacaactcataacagttgatgaaaaattggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaatag

SEQ ID NO: 707 - DNA, 303 bp, synthetic construct
  misc_feature 1..303: note = Synthetic polynucleotide
  source 1..303: mol_type = other DNA
ttcaagtcgttgaggacttccacatggagattggcacaggaccagactcaagacacacaactcataacagttgatgaaaaattggtttatcttgtaccactgtgttttacattctgtggtctagccacaccaagcctggaacttgctactctttttcctgcttcaaggcatttggagttcctgttcactctacctggatgcattttaactaatcctgaggacttcatccggtcaccatctacctattcttcaaatggatatcactactttaactggagttccagaagagcatataaaaactag

SEQ ID NO: 708 - DNA, 270 bp, synthetic construct
  misc_feature 1..270: note = Synthetic polynucleotide
  source 1..270: mol_type = other DNA
ttcaagtcgttgaggacttccacatggagattggcacaggaccagactcaagacacacaactcataacagttgatgaaaaattggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacgatggagctatga

SEQ ID NO: 709 - DNA, 3055 bp, synthetic construct
  misc_feature 1..3055: note = Synthetic polynucleotide
  source 1..3055: mol_type = other DNA
gactcagattcgaatcctggctttgctacatactacctgtgtgaggctctttaagcctcagtgacctcatctgtgaaatggtgtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctga

SEQ ID NO: 710 - DNA, 3058 bp, synthetic construct
  misc_feature 1..3058: note = Synthetic polynucleotide
  source 1..3058: mol_type = other DNA
gactcagattcgaatcctggctttgctacatactacctgtgtgaggctctttaagcctcagtgacctcatctgtgaaatggtgtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctga

SEQ ID NO: 711 - DNA, 970 bp, synthetic construct
  misc_feature 1..970: note = Synthetic polynucleotide
  source 1..970: mol_type = other DNA
cagagtggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactag

SEQ ID NO: 712 - DNA, 970 bp, synthetic construct; identical to SEQ ID NO: 711
  misc_feature 1..970: note = Synthetic polynucleotide
  source 1..970: mol_type = other DNA

SEQ ID NO: 713 - DNA, 970 bp, synthetic construct; identical to SEQ ID NO: 711
  misc_feature 1..970: note = Synthetic polynucleotide
  source 1..970: mol_type = other DNA

SEQ ID NO: 714 - DNA, 1681 bp, synthetic construct
  misc_feature 1..1681: note = Synthetic polynucleotide
  source 1..1681: mol_type = other DNA
aaaaggagccattagaactcacggagtccagcaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatga

SEQ ID NO: 715 - DNA, 1681 bp, synthetic construct; identical to SEQ ID NO: 714
  misc_feature 1..1681: note = Synthetic polynucleotide
  source 1..1681: mol_type = other DNA

SEQ ID NO: 716 - DNA, 1681 bp, synthetic construct; identical to SEQ ID NO: 714
  misc_feature 1..1681: note = Synthetic polynucleotide
  source 1..1681: mol_type = other DNA

SEQ ID NO: 717 - DNA, 1543 bp, synthetic construct
  misc_feature 1..1543: note = Synthetic polynucleotide
  source 1..1543: mol_type = other DNA
aaaaggagccattagaactcacggagtccagcaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatga

SEQ ID NO: 718 - DNA, 1681 bp, synthetic construct; identical to SEQ ID NO: 714
  misc_feature 1..1681: note = Synthetic polynucleotide
  source 1..1681: mol_type = other DNA

SEQ ID NO: 719 - DNA, 258 bp, synthetic construct
  misc_feature 1..258: note = Synthetic polynucleotide
  source 1..258: mol_type = other DNA
aaaaggagccattagaactcacggagtccagcaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcag

SEQ ID NO: 720 - DNA, 1027 bp, synthetic construct
  misc_feature 1..1027: note = Synthetic polynucleotide
  source 1..1027: mol_type = other DNA
aatttgggggccagtccgggattcccattctcctctgggcaagggtccctggtcctctcccatgaggaggcacgccctgcagcctcattgcggtggccttgtgtaaggaatcgaggcccacccagtgtgatgaataaacccggactctcagcaacgcaggaagaaacagaccaacaacttgggggaaaaaaaataatcacataccaggtaaccctgtgcatagaccaaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattga

SEQ ID NO: 721 - DNA, 648 bp, synthetic construct
  misc_feature 1..648: note = Synthetic polynucleotide
  source 1..648: mol_type = other DNA
aatttgggggccagtccgggattcccattctcctctgggcaagggtccctggtcctctcccatgaggaggcacgccctgcagcctcattgcggtggccttgtgtaaggaatcgaggcccacccagtgtgatgaataaacccggactctcagcaacgcaggaagaaacagaccaacaacttgggggaaaaaaaataatcacataccaggtaaccctgtgcatagaccaaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtga

SEQ ID NO: 722 - DNA, 643 bp, synthetic construct
  misc_feature 1..643: note = Synthetic polynucleotide
  source 1..643: mol_type = other DNA
aatttgggggccagtccgggattcccattctcctctgggcaagggtccctggtcctctcccatgaggaggcacgccctgcagcctcattgcggtggccttgtgtaaggaatcgaggcccacccagtgtgatgaataaacccggactctcagcaacgcaggaagaaacagaccaacaacttgggggaaaaaaaataatcacataccaggtaaccctgtgcatagaccaaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtata

SEQ ID NO: 723 - DNA, 335 bp, synthetic construct
  misc_feature 1..335: note = Synthetic polynucleotide
  source 1..335: mol_type = other DNA
aatttgggggccagtccgggattcccattctcctctgggcaagggtccctggtcctctcccatgaggaggcacgccctgcagcctcattgcggtggccttgtgtaaggaatcgaggcccacccagtgtgatgaataaacccggactctcagcaacgcaggaagaaacagaccaacaacttgggggaaaaaaaataatcacataccaggtaaccctgtgcatagaccaaggttaagaaatctccaaaacagttggctgcttacataaatagaacagttggacaaactgtgaaaagcccagataaacttcgtaaagtgatctatcgcagaaagaaag

SEQ ID NO: 724 - DNA, 767 bp, synthetic construct
  misc_feature 1..767: note = Synthetic polynucleotide
  source 1..767: mol_type = other DNA
ggccaggtgcggtcgctcacacctgtaatcccagcactttgggaggccgaggcgggcagatcacgaggtcaggagatcgagaccatcttggctaacacagagaaaccccatctctactaaaaatacgaaaaattagccgggcgtggtggcgggcgcctgtagtcccagctactccggaggctgatgcaggagaatgcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctga

SEQ ID NO: 725 - DNA, 767 bp, synthetic construct; identical to SEQ ID NO: 724
  misc_feature 1..767: note = Synthetic polynucleotide
  source 1..767: mol_type = other DNA

SEQ ID NO: 726 - DNA, 767 bp, synthetic construct; identical to SEQ ID NO: 724
  misc_feature 1..767: note = Synthetic polynucleotide
  source 1..767: mol_type = other DNA

SEQ ID NO: 727 - DNA, 767 bp, synthetic construct; identical to SEQ ID NO: 724
  misc_feature 1..767: note = Synthetic polynucleotide
  source 1..767: mol_type = other DNA

SEQ ID NO: 728 - DNA, 767 bp, synthetic construct; identical to SEQ ID NO: 724
  misc_feature 1..767: note = Synthetic polynucleotide
  source 1..767: mol_type = other DNA

SEQ ID NO: 729 - DNA, 1211 bp, synthetic construct
  misc_feature 1..1211: note = Synthetic polynucleotide
  source 1..1211: mol_type = other DNA
atatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattgtaagtttcctgaagcctccccaaccacacggaacaaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 730 - DNA, 806 bp, synthetic construct
  misc_feature 1..806: note = Synthetic polynucleotide
  source 1..806: mol_type = other DNA
atatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattgtaagtttcctgaagcctccccaaccacacggaacaaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtatatctatgttgctga

SEQ ID NO: 731 - DNA, 1175 bp, synthetic construct
  misc_feature 1..1175: note = Synthetic polynucleotide
  source 1..1175: mol_type = other DNA
atatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattgtaagtttcctgaagcctccccaaccacacggaacaaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 732 - DNA, 1211 bp, synthetic construct; identical to SEQ ID NO: 729
  misc_feature 1..1211: note = Synthetic polynucleotide
  source 1..1211: mol_type = other DNA

SEQ ID NO: 733 - DNA, 1680 bp, synthetic construct
  misc_feature 1..1680: note = Synthetic polynucleotide
  source 1..1680: mol_type = other DNA
ctccataaggacaaggactttggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaaaattacaggaaaagatatccatgacacagccagcagtgtggcacgtgggctacaattccagcgtggccttcagttctgcacacgtgcgtcaaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 734 - DNA, 1584 bp, synthetic construct
  misc_feature 1..1584: note = Synthetic polynucleotide
  source 1..1584: mol_type = other DNA
ctccataaggacaaggactttggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 735 - DNA, 1584 bp, synthetic construct; identical to SEQ ID NO: 734
  misc_feature 1..1584: note = Synthetic polynucleotide
  source 1..1584: mol_type = other DNA

SEQ ID NO: 736 - DNA, 1494 bp, synthetic construct
  misc_feature 1..1494: note = Synthetic polynucleotide
  source 1..1494: mol_type = other DNA
ctccataaggacaaggactttggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 737 - DNA, 1491 bp, synthetic construct
  misc_feature 1..1491: note = Synthetic polynucleotide
  source 1..1491: mol_type = other DNA
ctccataaggacaaggactttggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 738 - DNA, 1482 bp, synthetic construct
  misc_feature 1..1482: note = Synthetic polynucleotide
  source 1..1482: mol_type = other DNA
ctccataaggacaaggactttggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 739 - DNA, 1485 bp, synthetic construct
  misc_feature 1..1485: note = Synthetic polynucleotide
  source 1..1485: mol_type = other DNA
ctccataaggacaaggactttggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 740 - DNA, 1494 bp, synthetic construct; identical to SEQ ID NO: 736
  misc_feature 1..1494: note = Synthetic polynucleotide
  source 1..1494: mol_type = other DNA

SEQ ID NO: 741 - DNA, 1491 bp, synthetic construct; identical to SEQ ID NO: 737
  misc_feature 1..1491: note = Synthetic polynucleotide
  source 1..1491: mol_type = other DNA

SEQ ID NO: 742 - DNA, 59 bp, synthetic construct
  misc_feature 1..59: note = Synthetic polynucleotide
  source 1..59: mol_type = other DNA
taccagagtgcctggcacatagttggtgcttcataaaggaaaactgggagaaaacatga

SEQ ID NO: 743 - DNA, 123 bp, synthetic construct
  misc_feature 1..123: note = Synthetic polynucleotide
  source 1..123: mol_type = other DNA
taccagagtgcctggcacatagttggtgcttcataaaggaaaactgggagaaaacatgattcttaaacgagctgcatgggtgaaggtgccatctgggttctacgttggctcttatgtccacgg

SEQ ID NO: 744 - DNA, 445 bp, synthetic construct
  misc_feature 1..445: note = Synthetic polynucleotide
  source 1..445: mol_type = other DNA
taccagagtgcctggcacatagttggtgcttcataaaggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaatag

SEQ ID NO: 745 - DNA, 445 bp, synthetic construct; identical to SEQ ID NO: 744
  misc_feature 1..445: note = Synthetic polynucleotide
  source 1..445: mol_type = other DNA

SEQ ID NO: 746 - DNA, 445 bp, synthetic construct; identical to SEQ ID NO: 744
  misc_feature 1..445: note = Synthetic polynucleotide
  source 1..445: mol_type = other DNA

SEQ ID NO: 747 - DNA, 677 bp, synthetic construct
  misc_feature 1..677: note = Synthetic polynucleotide
  source 1..677: mol_type = other DNA
gcaccagcaagggttctgtttctgtttctggagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaagtaggacgcctcgtctaa

SEQ ID NO: 748 - DNA, 674 bp, synthetic construct
  misc_feature 1..674: note = Synthetic polynucleotide
  source 1..674: mol_type = other DNA
gcaccagcaagggttctgtttctgtttctggagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaa

SEQ ID NO: 749 - DNA, 400 bp, synthetic construct
  misc_feature 1..400: note = Synthetic polynucleotide
  source 1..400: mol_type = other DNA
gccgagcaccgtggctcatacttgtagtcccagtactttgggaggctgaggcggatggatcctttgaggtcaggagttaaagaccagcgcggccaacatgacgaaactccgtctctactaagaacacaacagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacg

SEQ ID NO: 750 - DNA, 2301 bp, synthetic construct
  misc_feature 1..2301: note = Synthetic polynucleotide
  source 1..2301: mol_type = other DNA
gccgagcaccgtggctcatacttgtagtcccagtactttgggaggctgaggcggatggatcctttgaggtcaggagttaaagaccagcgcggccaacatgacgaaactccgtctctactaagaacacaacagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctga

SEQ ID NO: 751 - DNA, 2381 bp, synthetic construct
  misc_feature 1..2381: note = Synthetic polynucleotide
  source 1..2381: mol_type = other DNA
gccgagcaccgtggctcatacttgtagtcccagtactttgggaggctgaggcggatggatcctttgaggtcaggagttaaagaccagcgcggccaacatgacgaaactccgtctctactaagaacacaacagggctaccagggcatggtggacggaggctcaaacatcgcagaggccgactgggagagtgtctccagcatcctgcaagtggtgctgtaaggggtgactggagggagaagcctggctgctggtcacaccgcttcccttgtcctggccggcatgctctggtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctga

SEQ ID NO: 752 - DNA, 692 bp, synthetic construct
  misc_feature 1..692: note = Synthetic polynucleotide
  source 1..692: mol_type = other DNA
gccgagcaccgtggctcatacttgtagtcccagtactttgggaggctgaggcggatggatcctttgaggtcaggagttaaagaccagcgcggccaacatgacgaaactccgtctctactaagaacacaacagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctggga

SEQ ID NO: 753 - DNA, 852 bp, synthetic construct
  misc_feature 1..852: note = Synthetic polynucleotide
  source 1..852: mol_type = other DNA
ggccgggcacagtagctcacacctgtaatcccagcactttggaaggccgagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattga

SEQ ID NO: 754 - DNA, 1036 bp, synthetic construct
  misc_feature 1..1036: note = Synthetic polynucleotide
  source 1..1036: mol_type = other DNA
gacaccaaaagcttgaaccataagtcaaaaaattgaaaattggacttcatcagaataaacttttgctcttccaagacaccactaagaaaatgacaagatagcacagacagcatatatatatatcagacaaaggtttagtatccagaatgtgtaaagaatagcttaagaaggcaaacaacccaataagaaaagggacttatatgatttatgcagataatttataagagaagataaaaatggccaagaagcacatgaaaagatactcaacattaccctagtcattgggggataacaaattaaaccactacatatccattacaatatctaaaatcagaaaacaaatgaaaaccccccaaaaccaaaatttgtgtgatgcatctggaactcttatgctctgatggtgagagagtaaaatgttacaaccgctttggaaaacaatccagggtttccttaaaaagtcaaatatctatttactgtaggaactagccatccaaccttaggtatttacccaagggaaatgaaaatacatgtctgcacaaagactcttacacaaatgtttattgcagtttcatttctaatgtcaaaaactggaaacaacctatatgtgtgttaacaggtgaatggataaagaaatcgtggtgcattcacacagtggaagactgctcggtggtagacactactgacgcatgcggtgatgtgggtgggtctcaaaatagtgaaggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtga

SEQ ID NO: 755 - DNA, 204 bp, synthetic construct
  misc_feature 1..204: note = Synthetic polynucleotide
  source 1..204: mol_type = other DNA
cagtgttttttaaactttgctttagaacttgtttggaacttgtcataaaatcgatcagtttggtgaattgcaaccaacaatatttaaaaagaaaacagaacagaacaaaatatcaggatgcaatgtgcatgcctaaatggaaacctgataaaaccagaggaggccaaagtctatgaagatgagaagcggattatctgtttctga

SEQ ID NO: 756 - DNA, 564 bp, synthetic construct
  misc_feature 1..564: note = Synthetic polynucleotide
  source 1..564: mol_type = other DNA
acacaattgttcacagaagtattataaccaaaaagtggcaacaactcatacgtccatcagctgatgaatggataaaatatggtgtaatcacacagtggaacgttattcagtcataggaagaaagtgctgatccacgctgcagcctggatgagccttgaaaacaccatgcgaagtggaagaagccggagacgaaaggccgcgtgttgtgtgatctcatctatatgagccgtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctga

SEQ ID NO: 757 - DNA, 564 bp, synthetic construct; identical to SEQ ID NO: 756
  misc_feature 1..564: note = Synthetic polynucleotide
  source 1..564: mol_type = other DNA

SEQ ID NO: 758 - DNA, 564 bp, synthetic construct; identical to SEQ ID NO: 756
  misc_feature 1..564: note = Synthetic polynucleotide
  source 1..564: mol_type = other DNA

SEQ ID NO: 759 - DNA, 597 bp, synthetic construct
  misc_feature 1..597: note = Synthetic polynucleotide
  source 1..597: mol_type = other DNA
ccttagagccttaggctccactttcttcctcagctgccacatccaaaccatggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaa

SEQ ID NO: 760 - DNA, 654 bp, synthetic construct
  misc_feature 1..654: note = Synthetic polynucleotide
  source 1..654: mol_type = other DNA
ccttagagccttaggctccactttcttcctcagctgccacatccaaaccatggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagttggagaaacgtacggtaaggatataacctcccggggcaaagacaagccgattgccgatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaa

SEQ ID NO: 761 - DNA, 1175 bp, synthetic construct
  misc_feature 1..1175: note = Synthetic polynucleotide
  source 1..1175: mol_type = other DNA
atatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 762 - DNA, 770 bp, synthetic construct
  misc_feature 1..770: note = Synthetic polynucleotide
  source 1..770: mol_type = other DNA
atatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtatatctatgttgctga

SEQ ID NO: 763 - DNA, 1139 bp, synthetic construct
  misc_feature 1..1139: note = Synthetic polynucleotide
  source 1..1139: mol_type = other DNA
atatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 764 - DNA, 1175 bp, synthetic construct; identical to SEQ ID NO: 761
  misc_feature 1..1175: note = Synthetic polynucleotide
  source 1..1175: mol_type = other DNA

SEQ ID NO: 765 - DNA, 1217 bp, synthetic construct
  misc_feature 1..1217: note = Synthetic polynucleotide
  source 1..1217: mol_type = other DNA
caagagtggttgaggcttggcacttgccacctagatttcagacaatgtgtcaggaatcctggatgcccagaaagaaacctgctcagggtctggagccccaacataaagcttttatttaggcaatgttgagcactaatatgtggttggagctctgcagggggtctccatgggtgcactgtgtagcaaagctgtgggagaaaggccttacccctcaaaattccagaattataaatctatcagccgcttgcaacttcagcctggaaaagccatgggcattaaactccaaactgtgagagcagccatgtgggctgcaccctgcaaagccacaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 766 - DNA, 1139 bp, synthetic construct
  misc_feature 1..1139: note = Synthetic polynucleotide
  source 1..1139: mol_type = other DNA
caagagtggttgaggcttggcacttgccacctagatttcagacaatgtgtcaggaatcctggatgcccagaaagaaacctgctcagggtctggagccccaacataaagcttttatttaggcaatgttgagcactaatatgtggttggagctctgcagggggtctccatgggtgcactgtgtagcaaagctgtgggagaaaggccttacccctcaaaattccagaattataaatctatcagccgcttgcaacttcagcctggaaaagccatgggcattaaactccaaactgtgagagcagccatgtgggctgcaccctgcaaagccacaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 767 - DNA, 1217 bp, synthetic construct; identical to SEQ ID NO: 765
  misc_feature 1..1217: note = Synthetic polynucleotide
  source 1..1217: mol_type = other DNA

SEQ ID NO: 768 - DNA, 847 bp, synthetic construct
  misc_feature 1..847: note = Synthetic polynucleotide
  source 1..847: mol_type = other DNA
caagagtggttgaggcttggcacttgccacctagatttcagacaatgtgtcaggaatcctggatgcccagaaagaaacctgctcagggtctggagccccaacataaagcttttatttaggcaatgttgagcactaatatgtggttggagctctgcagggggtctccatgggtgcactgtgtagcaaagctgtgggagaaaggccttacccctcaaaattccagaattataaatctatcagccgcttgcaacttcagcctggaaaagccatgggcattaaactccaaactgtgagagcagccatgtgggctgcaccctgcaaagccacaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 769 - DNA, 665 bp, synthetic construct
  misc_feature 1..665: note = Synthetic polynucleotide
  source 1..665: mol_type = other DNA
caagagtggttgaggcttggcacttgccacctagatttcagacaatgtgtcaggaatcctggatgcccagaaagaaacctgctcagggtctggagccccaacataaagcttttatttaggcaatgttgagcactaatatgtggttggagctctgcagggggtctccatgggtgcactgtgtagcaaagctgtgggagaaaggccttacccctcaaaattccagaattataaatctatcagccgcttgcaacttcagcctggaaaagccatgggcattaaactccaaactgtgagagcagccatgtgggctgcaccctgcaaagccacaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 770 - DNA, 318 bp, synthetic construct
  misc_feature 1..318: note = Synthetic polynucleotide
  source 1..318: mol_type = other DNA
caggcatacctcgttttattatgcttcgccttattgcactttgcagatgttgcattttttcaaattgagagtttgtggcaagcctgccttgagcaagtctatgggagccatttttccaacagcatgtgctcacttcctgtctctgtgtctcattttgaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatac

SEQ ID NO: 771 - DNA, 1471 bp, synthetic construct
  misc_feature 1..1471: note = Synthetic polynucleotide
  source 1..1471: mol_type = other DNA
caggcatacctcgttttattatgcttcgccttattgcactttgcagatgttgcattttttcaaattgagagtttgtggcaagcctgccttgagcaagtctatgggagccatttttccaacagcatgtgctcacttcctgtctctgtgtctcattttgaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctga

SEQ ID NO: 772 - DNA, 1366 bp, synthetic construct
  misc_feature 1..1366: note = Synthetic polynucleotide
  source 1..1366: mol_type = other DNA
caggcatacctcgttttattatgcttcgccttattgcactttgcagatgttgcattttttcaaattgagagtttgtggcaagcctgccttgagcaagtctatgggagccatttttccaacagcatgtgctcacttcctgtctctgtgtctcattttgaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaaggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctga

SEQ ID NO: 773 - DNA, 299 bp, synthetic construct
  misc_feature 1..299: note = Synthetic polynucleotide
  source 1..299: mol_type = other DNA
aactgtcagagtctcccccgccctcccccactgaggctgggtttggtacccatccttctgggctcccgtgtgttctgtgtcctttgtcactcaggtagtcgcacgctatagctgtctccccactaggctgtcacgggctgggacccgacgagatcctggtctgggttttcagaaggccctcccgccgcagcgacctccagagcctgggctactgcatgctgaagtggctctacgggtttctgccatggacaaattgccttcccaacactgaggacatcatgaagcaaaaacagaagtga

SEQ ID NO: 774 - DNA, 503 bp, synthetic construct
  misc_feature 1..503: note = Synthetic polynucleotide
  source 1..503: mol_type = other DNA
aactgtcagagtctcccccgccctcccccactgaggctgggtttggtacccatccttctgggctcccgtgtgttctgtgtcctttgtcactcaggtagtcgcacgctatagctgtctccccactaggctgtcacgggctgggacccgacgagatcctggtctgggttttcagaaggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctag

SEQ ID NO: 775 - DNA, 503 bp, synthetic construct; identical to SEQ ID NO: 774
  misc_feature 1..503: note = Synthetic polynucleotide
  source 1..503: mol_type = other DNA

SEQ ID NO: 776 - DNA, 503 bp, synthetic construct; identical to SEQ ID NO: 774
  misc_feature 1..503: note = Synthetic polynucleotide
  source 1..503: mol_type = other DNA

SEQ ID NO: 777 - DNA, 503 bp, synthetic construct; identical to SEQ ID NO: 774
  misc_feature 1..503: note = Synthetic polynucleotide
  source 1..503: mol_type = other DNA

SEQ ID NO: 778 - DNA, 503 bp, synthetic construct; identical to SEQ ID NO: 774
  misc_feature 1..503: note = Synthetic polynucleotide
  source 1..503: mol_type = other DNA

SEQ ID NO: 779 - DNA, 503 bp, synthetic construct; identical to SEQ ID NO: 774
  misc_feature 1..503: note = Synthetic polynucleotide
  source 1..503: mol_type = other DNA

SEQ ID NO: 780 - DNA, 317 bp, synthetic construct
  misc_feature 1..317: note = Synthetic polynucleotide
  source 1..317: mol_type = other DNA
aactgtcagagtctcccccgccctcccccactgaggctgggtttggtacccatccttctgggctcccgtgtgttctgtgtcctttgtcactcaggtagtcgcacgctatagctgtctccccactaggctgtcacgggctgggacccgacgagatcctggtctgggttttcagaaggccctcccgccgcagcgacctccagagcctgggctactgcatgctgaagtggctctacgggtttctgccatggacaaattgccttcccaacactgaggacatcatgaagcaaaaacagaagttgccttgggattcattttaa

SEQ ID NO: 781 - DNA, 317 bp, synthetic construct; identical to SEQ ID NO: 780
  misc_feature 1..317: note = Synthetic polynucleotide
  source 1..317: mol_type = other DNA

SEQ ID NO: 782 - DNA, 344 bp, synthetic construct
  misc_feature 1..344: note = Synthetic polynucleotide
  source 1..344: mol_type = other DNA
aactgtcagagtctcccccgccctcccccactgaggctgggtttggtacccatccttctgggctcccgtgtgttctgtgtcctttgtcactcaggtagtcgcacgctatagctgtctccccactaggctgtcacgggctgggacccgacgagatcctggtctgggttttcagaaggccctcccgccgcagcgacctccagagcctgggctactgcatgctgaagtggctctacgggtttctgccatggacaaattgccttcccaacactgaggacatcatgaagcaaaaacagaaatgtatttgtaccctcaaaatcgcatgctggccgtggtgctgtgtgtga

SEQ ID NO: 783 - DNA, 1328 bp, synthetic construct
  misc_feature 1..1328: note = Synthetic polynucleotide
  source 1..1328: mol_type = other DNA
tgttaaagtgaaccccaagtttctcttcaaagaatcagtaagttcaggtctcttactctttgattcactattttaaagtttaacttcctggttctcttcgccctcttgcttctagtttcagtaaacaaccttttccaccagttttaatcagtagttcacatctgttcccccggtcacctactccgtcctgactcatcccggtcacctgctttgacctgagtcaccctggtcacctgctctgacctaagtcacctttaattacctgttcctaactgtccttcccaccaaactactcaccccaccactctggctcataaacctgttccctttaaaatagccaatcagaattagcttagactgtgtggttcaaccctagccaataggggaacgacatagcagtagggactacctgcgtcagaaataagaactccttcccctcccctgtccagttgtgttctcaccattgttccatctgcgaggagcaccctttctgcagaaagtaaaaattgccttgctgaggaaattaaatatagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcagcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtga

SEQ ID NO: 784 - DNA, 1325 bp, synthetic construct
  misc_feature 1..1325: note = Synthetic polynucleotide
  source 1..1325: mol_type = other DNA
tgttaaagtgaaccccaagtttctcttcaaagaatcagtaagttcaggtctcttactctttgattcactattttaaagtttaacttcctggttctcttcgccctcttgcttctagtttcagtaaacaaccttttccaccagttttaatcagtagttcacatctgttcccccggtcacctactccgtcctgactcatcccggtcacctgctttgacctgagtcaccctggtcacctgctctgacctaagtcacctttaattacctgttcctaactgtccttcccaccaaactactcaccccaccactctggctcataaacctgttccctttaaaatagccaatcagaattagcttagactgtgtggttcaaccctagccaataggggaacgacatagcagtagggactacctgcgtcagaaataagaactccttcccctcccctgtccagttgtgttctcaccattgttccatctgcgaggagcaccctttctgcagaaagtaaaaattgccttgctgaggaaattaaatatagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtga

SEQ ID NO: 785 - DNA, 1328 bp, synthetic construct; identical to SEQ ID NO: 783
  misc_feature 1..1328: note = Synthetic polynucleotide
  source 1..1328: mol_type = other DNA

SEQ ID NO: 786 - DNA, 1325 bp, synthetic construct; identical to SEQ ID NO: 784
  misc_feature 1..1325: note = Synthetic polynucleotide
  source 1..1325: mol_type = other DNA

SEQ ID NO: 787 - DNA, 541 bp, synthetic construct
  misc_feature 1..541: note = Synthetic polynucleotide
  source 1..541: mol_type = other DNA
gaaacctggctctgccacttcccaaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactga

SEQ ID NO: 788 - DNA, 541 bp, synthetic construct; identical to SEQ ID NO: 787
  misc_feature 1..541: note = Synthetic polynucleotide
  source 1..541: mol_type = other DNA

SEQ ID NO: 789 - DNA, 1052 bp, synthetic construct
  misc_feature 1..1052: note = Synthetic polynucleotide
  source 1..1052: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 790 - DNA, 974 bp, synthetic construct
  misc_feature 1..974: note = Synthetic polynucleotide
  source 1..974: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 791 - DNA, 1052 bp, synthetic construct; identical to SEQ ID NO: 789
  misc_feature 1..1052: note = Synthetic polynucleotide
  source 1..1052: mol_type = other DNA

SEQ ID NO: 792 - DNA, 682 bp, synthetic construct
  misc_feature 1..682: note = Synthetic polynucleotide
  source 1..682: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 793 - DNA, 500 bp, synthetic construct
  misc_feature 1..500: note = Synthetic polynucleotide
  source 1..500: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 794 - DNA, 1024 bp, synthetic construct
  misc_feature 1..1024: note = Synthetic polynucleotide
  source 1..1024: mol_type = other DNA
gtggccttggccaacacccaaggcctctctggacttcatgacaccaactgtaatatgaagataatcataatagtgaccttgtaagaagtttttgaggattaagttaaaaatacatctgaagggctacgggcacgcggcacccagcacggatggcggcaaggtgttctgcatgttctacgcgctgctgggcatcccgctcacgctcgtcatgttccagagcctgggcgagcgcatcaacaccttggtgaggtacctgctgcaccgcgccaagaaggggctgggcatgcggcgcgccgacgtgtccatggccaacatggtgctcatcggcttcttctcgtgcatcagcacgctgtgcatcggcgccgccgccttctcccactacgagcactggaccttcttccaggcctactactactgcttcatcaccctcaccaccatcggcttcggcgactacgtggcgctgcagaaggaccaggccctgcagacgcagccgcagtacgtggccttcagcttcgtctacatccttacgggcctcacggtcatcggcgccttcctcaacctcgtggtgctgcgcttcatgaccatgaacgccgaggacgagaagcgcgacgccgagcaccgcgcgctgctcacgcgcaacgggcaggcgggcggcggcggagggggtggcagcgcgcacactacggacaccgcctcatccacggcggcagcgggcggcggcggcttccgcaacgtctacgcggaggtgctgcacttccagtccatgtgctcgtgcctgtggtacaagagccgcgagaagctgcagtactccatccccatgatcatcccgcgggacctctccacgtccgacacgtgcgtggagcagagccactcgtcgccgggagggggcggccgctacagcgacacgccctcgcgacgctgcctgtgcagcggggcgccacgctccgccatcagctcggtgtccacgggtctgcacagcctgtccaccttccgcggcctcatgaagcgcaggagctccgtgtga

SEQ ID NO: 795 - DNA, 1279 bp, synthetic construct
  misc_feature 1..1279: note = Synthetic polynucleotide
  source 1..1279: mol_type = other DNA
ctctccctctccctctccctctccctcgccctctcccctttccacggtctcccctctccctctctttccacggtctccctctcacgccgagccgaagctggactgtactgccgccatctcggctcactgcagcctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccacgagtgatccgccagcctcggcctcctgaggtgccgggattgcagacagagtctcgttaactcagtgctcaatggtgcccaggctggagtgcagtggcgtgatctcggctccctgcagcctccacctcccagccgcctgccttggccccccacagtgccgagattgcagcctctgcccggccgccactccgtctgggaagtgaggagcgtctctgcctggccgcccatcgtctgggatgtgaggagcccctctgcctggctgcccagtctggaaagtgaggagcctctctgcccggccgccatcccacctaggaagtgaggagcgcctcttcccggccgccatcccatctaggaagtgaggagcgtctctgcccggccgccccgtctgagaagtgaggagaccctccgcctggcaactgccccgtctgagaagtgaggagcccctccgcccggcagctgccccgtctgagaagtgaggagcccctccgcccggctgacaccccgtctgggaagtccacaatctgcaggagctccggcgaagtgcctcactggccaccaaggtctttatccagagagactacagcgatgggaccatctgtcagttccagaccaaattccccccagagctggacagccggatcgagcggcagctctttgaagagactgtgaagaccctcaacggattttacgcagaggctgagaagattgggggcagctcctacctcgagggctgcctggcctgcgccacggcctacttcatcttcctctgcatggagacccactatgagaaggttctcaagaagatttcccgctacatccaggagcagaatgagaagatctttgcacctcgaggcctcctacttacagaccctgtggagcgtgggatgagggttattgagatctccatctacgaggaccggtgcagcagtggcagctccagcagcggcagcagcagcggcagtggcagcagcagcggtgggggtggtggggcgggggcccggtga

SEQ ID NO: 796 - DNA, 590 bp, synthetic construct
  misc_feature 1..590: note = Synthetic polynucleotide
  source 1..590: mol_type = other DNA
gccttttggaaactcagggcagctctgtggattgtcacagcaactggagctcctgctgtattttcaggatggtcccgggaggcaggtgttctgcagccatggggcactcccttagcaatgaagactggccccccattccacttgacttctgaatgtccctgggacactcatgagagtccgaagcctgtttatgatgacctgagcctcatcccaagtgcattgtggacacacacaggagacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatag

SEQ ID NO: 797 - DNA, 590 bp, synthetic construct; identical to SEQ ID NO: 796
  misc_feature 1..590: note = Synthetic polynucleotide
  source 1..590: mol_type = other DNA

SEQ ID NO: 798 - DNA, 590 bp, synthetic construct; identical to SEQ ID NO: 796
  misc_feature 1..590: note = Synthetic polynucleotide
  source 1..590: mol_type = other DNA

SEQ ID NO: 799 - DNA, 590 bp, synthetic construct; identical to SEQ ID NO: 796
  misc_feature 1..590: note = Synthetic polynucleotide
  source 1..590: mol_type = other DNA

SEQ ID NO: 800 - DNA, 590 bp, synthetic construct; identical to SEQ ID NO: 796
  misc_feature 1..590: note = Synthetic polynucleotide
  source 1..590: mol_type = other DNA

SEQ ID NO: 801 - DNA, 590 bp, synthetic construct; identical to SEQ ID NO: 796
  misc_feature 1..590: note = Synthetic polynucleotide
  source 1..590: mol_type = other DNA

SEQ ID NO: 802 - DNA, 590 bp, synthetic construct; identical to SEQ ID NO: 796
  misc_feature 1..590: note = Synthetic polynucleotide
  source 1..590: mol_type = other DNA

SEQ ID NO: 803 - DNA, 463 bp, synthetic construct
  misc_feature 1..463: note = Synthetic polynucleotide
  source 1..463: mol_type = other DNA
ggccaggcacggtggctcacgcctgtaatcccagcactttgggaggccgaggcaggcggatcacctgaggtcaggagttcgagaccagcctgaccacatggagaaaccccgcctctgctaaaagtacaaaattagccaggcgtggtggcaggagcctgtaattccagctactcaggagactgaggcaggagaatcgcttgaacccaggaggcggaggttgcggtctggagtgggactgactggctccagacagaccatgttctacacagaggtgacagatgcccagcgtagcggtccaggtgggggcctggtggaggagggtgagctcattgaggtggtgcacctgcccctggaaggcgcccaggcctttgcagacgacccggacatccccaagaccctcggcgtcatctttggtgtctcatggttcctcagccaggtggcccccaacctggatctccagtga

SEQ ID NO: 804 - DNA, 745 bp, synthetic construct
  misc_feature 1..745: note = Synthetic polynucleotide
  source 1..745: mol_type = other DNA
ggtatggtggctcacacctgtatttccagctgctcaggagaccgaggctgaagcacgaagatcgcttgagctcaggcattaaagaccagcctgggctggaatatttcaggagtttaaagttcaggaagagtctgttacttttcgaattaatttaactgtccttttagactgtttatctatttttggatcaagtcctatgccagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttga

SEQ ID NO: 805 - DNA, 745 bp, synthetic construct; identical to SEQ ID NO: 804
  misc_feature 1..745: note = Synthetic polynucleotide
  source 1..745: mol_type = other DNA

SEQ ID NO: 806 - DNA, 1392 bp, synthetic construct
  misc_feature 1..1392: note = Synthetic polynucleotide
  source 1..1392: mol_type = other DNA
ggccaggtgtggtggcttgtgcgtgtaatcccagaactttgggaggccaaggcaggtggattacctgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtag

SEQ ID NO: 807 - DNA, 1191 bp, synthetic construct
  misc_feature 1..1191: note = Synthetic polynucleotide
  source 1..1191: mol_type = other DNA
ggccaggtgtggtggcttgtgcgtgtaatcccagaactttgggaggccaaggcaggtggattacctgagccaggactaaaagaagtggtagaatcctgtcgaggaaaaaatctttttttttctaccaatattgatgatgccatcaaagaagctgatcttgtatttatttctgtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtag

SEQ ID NO: 808 - DNA, 1392 bp, synthetic construct; identical to SEQ ID NO: 806
  misc_feature 1..1392: note = Synthetic polynucleotide
  source 1..1392: mol_type = other DNA

SEQ ID NO: 809 - DNA, 412 bp, synthetic construct
  misc_feature 1..412: note = Synthetic polynucleotide
  source 1..412: mol_type = other DNA
ggccaggtgtggtggcttgtgcgtgtaatcccagaactttgggaggccaaggcaggtggattacctgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagcca

SEQ ID NO: 810 - DNA, 366 bp, synthetic construct
  misc_feature 1..366: note = Synthetic polynucleotide
  source 1..366: mol_type = other DNA
ggccaggtgtggtggcttgtgcgtgtaatcccagaactttgggaggccaaggcaggtggattacctgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaat

SEQ ID NO: 811 - DNA, 297 bp, synthetic construct
  misc_feature 1..297: note = Synthetic polynucleotide
  source 1..297: mol_type = other DNA
ggccaggtgtggtggcttgtgcgtgtaatcccagaactttgggaggccaaggcaggtggattacctgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagc

SEQ ID NO: 812 - DNA, 161 bp, synthetic construct
  misc_feature 1..161: note = Synthetic polynucleotide
  source 1..161: mol_type = other DNA
ggccaggtgtggtggcttgtgcgtgtaatcccagaactttgggaggccaaggcaggtggattacctgagccaggactaaaagaagtggtagaatcctgtcgaggaaaaaatctttttttttctaccaatattgatgatgccatcaaagaagctgatcttgt

SEQ ID NO: 813 - DNA, 460 bp, synthetic construct
  misc_feature 1..460: note = Synthetic polynucleotide
  source 1..460: mol_type = other DNA
catttgatctccgggagccctggctccctcgcttggaacaggagccacagctgccgcgtgggatgatgatgtgctggtggacggacagccatgtgaccgcgaggctgtggcggcctgccaggtgggcgaccccgtgcgcctggaggtgcggctgaccaaccggagcccgcgcagcgtagggcccttcgccctcactgtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagctgccaccctcttggttctgcctgcccagtgtgcacgtgtgtgccctggaggcgcaggcctga

SEQ ID NO: 814 - DNA, 460 bp, synthetic construct; identical to SEQ ID NO: 813
  misc_feature 1..460: note = Synthetic polynucleotide
  source 1..460: mol_type = other DNA

SEQ ID NO: 815 - DNA, 460 bp, synthetic construct; identical to SEQ ID NO: 813
  misc_feature 1..460: note = Synthetic polynucleotide
  source 1..460: mol_type = other DNA

SEQ ID NO: 816 - DNA, 460 bp, synthetic construct; identical to SEQ ID NO: 813
  misc_feature 1..460: note = Synthetic polynucleotide
  source 1..460: mol_type = other DNA

SEQ ID NO: 817 - DNA, 636 bp, synthetic construct
  misc_feature 1..636: note = Synthetic polynucleotide
  source 1..636: mol_type = other DNA
ggctgggcgcggtagctcacaccttataatcccaacactttggggggctaaggtgggcggatcacttgaggtcaggagttcgagaccagcctggccaacattgcaaaaccctgtctctactaaaaatacaaaaattatccaggcatggtggtgcatgcctgtaatttcagctactcgggaggctgaggcacaagaatcatttgaaccgtggagacagaggttgcgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctga

SEQ ID NO: 818 - DNA, 636 bp, synthetic construct; identical to SEQ ID NO: 817
  misc_feature 1..636: note = Synthetic polynucleotide
  source 1..636: mol_type = other DNA

SEQ ID NO: 819 - DNA, 582 bp, synthetic construct
  misc_feature 1..582: note = Synthetic polynucleotide
  source 1..582: mol_type = other DNA
ggctgggcgcggtagctcacaccttataatcccaacactttggggggctaaggtgggcggatcacttgaggtcaggagttcgagaccagcctggccaacattgcaaaaccctgtctctactaaaaatacaaaaattatccaggcatggtggtgcatgcctgtaatttcagctactcgggaggctgaggcacaagaatcatttgaaccgtggagacagaggttgcgatgtctggcgataaagggatttctgccttccctgaatcagacaaccttttcaaatgggtagggaccatccatggagcagctggaacagcagtggggagcatcagaaccagctcaacagtttgtctactgtccggtcccagagaaactcaagattctagcaagccccttgtgtggggcttgggttgggacatgaggctgctgctggagcttactctgcaactgtttctccaaatgccagaacccaacattgatagtcccttgaacacacatgctgccgagctctggaaaaaccccacagcttttaagaagtacctgcaagaaacctactcaaagcaggtcaccagccaggagccctga

SEQ ID NO: 820 - DNA, 636 bp, synthetic construct; identical to SEQ ID NO: 817
  misc_feature 1..636: note = Synthetic polynucleotide
  source 1..636: mol_type = other DNA

SEQ ID NO: 821 - DNA, 718 bp, synthetic construct
  misc_feature 1..718: note = Synthetic polynucleotide
  source 1..718: mol_type = other DNA
gcgcgacgcagcggcgcggcgcgtggcgtaaggggcgtggcgccagtgggcgtggcgtggcgcagtgcgaagggacgcggcccagacatgtccgtccttgtaagttaaaagcttccatgggagccttccttcctaatcaagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaa

SEQ ID NO: 822 - DNA, 1913 bp, synthetic construct
  misc_feature 1..1913: note = Synthetic polynucleotide
  source 1..1913: mol_type = other DNA
ccttttccccagtagtttcactccaggaatccctcagataactcccacatgtggaaaaacgtctgtttcaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactag

SEQ ID NO: 823 - DNA, 1913 bp, synthetic construct; identical to SEQ ID NO: 822
  misc_feature 1..1913: note = Synthetic polynucleotide
  source 1..1913: mol_type = other DNA

SEQ ID NO: 824 - DNA, 1874 bp, synthetic construct
  misc_feature 1..1874: note = Synthetic polynucleotide
  source 1..1874: mol_type = other DNA
ccttttccccagtagtttcactccaggaatccctcagataactcccacatgtggaaaaacgtctgtttcaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtccgtaattgagcaggtctcgtgggatacctga

SEQ ID NO: 825 - DNA, 1874 bp, synthetic construct; identical to SEQ ID NO: 824
  misc_feature 1..1874: note = Synthetic polynucleotide
  source 1..1874: mol_type = other DNA

SEQ ID NO: 826 - DNA, 1913 bp, synthetic construct; identical to SEQ ID NO: 822
  misc_feature 1..1913: note = Synthetic polynucleotide
  source 1..1913: mol_type = other DNA

SEQ ID NO: 827 - DNA, 362 bp, synthetic construct
  misc_feature 1..362: note = Synthetic polynucleotide
  source 1..362: mol_type = other DNA
ggccgggcacggtggctcacacctgtaattctaacactttgggaggccgaggaatgaacccctcccagaggtacccactgtggtacaagaacatggtgtccctgtggatcctctttgggatggcatggctggccttgatcatcaaactcatcctctcccagctggagacgccagggagggtatgttcctgctgccaccacagctctaaggaagacttcaagtcccaaagctggagacagggacctgaccgggagccagagtcccactccccacagcaaggatgctatccagagggacccatgggaatcatacagcatctggaaccttctgctcacgctgcaggctgtggcaaggacagctag

SEQ ID NO: 828 - DNA, 1583 bp, synthetic construct
  misc_feature 1..1583: note = Synthetic polynucleotide
  source 1..1583: mol_type = other DNA
atgcagctgaagttgcctcagggctaccagcccggtggagggttgggagaattttgcagaaacctctttgctcctctggtaggcatttgaaaatgtggcttgggtcaggaacaggcgcccccacccgccgggtcccaggtgttcttcgattttcctttgcattgatggataggtcactcattccccctttgcaccggcacatgcctggacaccaccgtttctttcgccgtcgccccgtatgcctccggtgatacacgttcacaccatctgctgtgggatacgccagtgcctcgcatgttcccgtggtctccacctcgcattcgcccctgttcctgtttgcacgagtcctgtaaagcgcggtcggctttcctgagccccagggcttttagaagcggggtatgccactgctctttcaaaggaggagggaggcagagggttgaatgatcagtgaatttgcagccgacactttgcctcgagacctgtgggatcattctttgctgcatggaggccctgcctgccccagcagatgtggcgagcccatcctatgtcactcggtgggggcctaaatcggatctgaaggggtgtcctgagaacacagcaggcgtcctgaagctccctctccctccctccgtggaagtcagctcaaggagttcctgaggacaggattcctgggggtttggtcctgggacaggacaagacacccacggtcccgtctcccacgccgccacaaactggagcccggatccaggccgcggctgcagcgggaacctcgctgccctgcgctgcagtagcgttatttaaaggggatgcagcctgactgccagaagcggagcgctagtcaggccagccaatgcgcatgcgcgcggcgcgagcgacttctcctgtcacagtggttcccacggttgtcttagaaaccagtccctgaggcttggcaaagcaggagccctccgtggcagtgcttgtgtgtcggggctctgaggctccggcctgacctctccacagggtcgacgggaacgtctctggatgccaggagacgcaaagggccgaccagaatgaggaattcccaggcggagtccaggggaggcagcacggcatcccagcctcagggctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtga

SEQ ID NO: 829 - DNA, 1421 bp, synthetic construct
  misc_feature 1..1421: note = Synthetic polynucleotide
  source 1..1421: mol_type = other DNA
atgcagctgaagttgcctcagggctaccagcccggtggagggttgggagaattttgcagaaacctctttgctcctctggtaggcatttgaaaatgtggcttgggtcaggaacaggcgcccccacccgccgggtcccaggtgttcttcgattttcctttgcattgatggataggtcactcattccccctttgcaccggcacatgcctggacaccaccgtttctttcgccgtcgccccgtatgcctccggtgatacacgttcacaccatctgctgtgggatacgccagtgcctcgcatgttcccgtggtctccacctcgcattcgcccctgttcctgtttgcacgagtcctgtaaagcgcggtcggctttcctgagccccagggcttttagaagcggggtatgccactgctctttcaaaggaggagggaggcagagggttgaatgatcagtgaatttgcagccgacactttgcctcgagacctgtgggatcattctttgctgcatggaggccctgcctgccccagcagatgtggcgagcccatcctatgtcactcggtgggggcctaaatcggatctgaaggggtgtcctgagaacacagcaggcgtcctgaagctccctctccctccctccgtggaagtcagctcaaggagttcctgaggacaggattcctgggggtttggtcctgggacaggacaagacacccacggtcccgtctcccacgccgccacaaactggagcccggatccaggccgcggctgcagcgggaacctcgctgccctgcgctgcagtagcgttatttaaaggggatgcagcctgactgccagaagcggagcgctagtcaggccagccaatgcgcatgcgcgcggcgcgagcgacttctcctgtcacagtggttcccacggttgtcttagaaaccagtccctgaggcttggcaaagcaggagccctccgtggcagtgcttgtgtgtcggggctctgaggctccggcctgacctctccacagggtcgacgggaacgtctctggatgccaggagacgcaaagggccgaccagaatgaggaattcccaggcggagtccaggggaggcagcacggcatcccagcctcagggctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 830 - DNA, 136 bp, synthetic construct
  misc_feature 1..136: note = Synthetic polynucleotide
  source 1..136: mol_type = other DNA
ttggtcgctgtggcacccactgaataaaaggagactcagtggcagtggatctgggacagatttcactctcaccatcagcagcctgcagcctgaagattttgcaacttattactgtcaacagtttaataattaccct

SEQ ID NO: 831 - DNA, 164 bp, synthetic construct
  misc_feature 1..164: note = Synthetic polynucleotide
  source 1..164: mol_type = other DNA
tttttaaaattaataataattagcaaagcatggtagctcacacgtttactcccagctactcaggaggcagaggagccgggaggatcacttgagcccaggagttcaaggctgtggagggcatcctggctgtttcacccgtggacttgaacttgccattggactga

SEQ ID NO: 832 - DNA, 164 bp, synthetic construct; identical to SEQ ID NO: 831
  misc_feature 1..164: note = Synthetic polynucleotide
  source 1..164: mol_type = other DNA

SEQ ID NO: 833 - DNA, 164 bp, synthetic construct; identical to SEQ ID NO: 831
  misc_feature 1..164: note = Synthetic polynucleotide
  source 1..164: mol_type = other DNA

SEQ ID NO: 834 - DNA, 193 bp, synthetic construct
  misc_feature 1..193: note = Synthetic polynucleotide
  source 1..193: mol_type = other DNA
tttttaaaattaataataattagcaaagcatggtagctcacacgtttactcccagctactcaggaggcagaggagccgggaggatcacttgagcccaggagttcaaggctgtggagggcatcctggctgtttcacccgtggacttgaacttgccattggactgagctctttctcagaagctgctacaagatga

SEQ ID NO: 835 - DNA, 915 bp, synthetic construct
  misc_feature 1..915: note = Synthetic polynucleotide
  source 1..915: mol_type = other DNA
gttttctcttgtctccaggcctttgcacaggctttttcttcaacttggagtatttccctgcttctatccgtcccaactcccctgccaaactgttctctttcggttattgatttaaatgtcacttcttccgggaagccttcccacgcttcctctggctagattgtttgctttttcttaggttgttgggtttttcgtttatgtcactctctcattctgtgtttaaattgccagcttttttgttctgaactcccactgcgttgtggattcctgaggatgggatgactgtatcttgattacccggaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaa

SEQ ID NO: 836 - DNA, 735 bp, synthetic construct
  misc_feature 1..735: note = Synthetic polynucleotide
  source 1..735: mol_type = other DNA
gttttctcttgtctccaggcctttgcacaggctttttcttcaacttggagtatttccctgcttctatccgtcccaactcccctgccaaactgttctctttcggttattgatttaaatgtcacttcttccgggaagccttcccacgcttcctctggctagattgtttgctttttcttaggttgttgggtttttcgtttatgtcactctctcattctgtgtttaaattgccagcttttttgttctgaactcccactgcgttgtggattcctgaggatgggatgactgtatcttgattacccggaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtaa

SEQ ID NO: 837 - DNA, 451 bp, synthetic construct
  misc_feature 1..451: note = Synthetic polynucleotide
  source 1..451: mol_type = other DNA
ttcctagtgtgcgggtccccaagcctgggagttgtccttgataccttggtacagtctcatccctacagccaatcataagtggattagattgtctctgccttctgaacacacctgaattcatccatggcttcatgccctgttgcaggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaa

SEQ ID NO: 838 - DNA, 451 bp, synthetic construct; identical to SEQ ID NO: 837
  misc_feature 1..451: note = Synthetic polynucleotide
  source 1..451: mol_type = other DNA

SEQ ID NO: 839 - DNA, 451 bp, synthetic construct; identical to SEQ ID NO: 837
  misc_feature 1..451: note = Synthetic polynucleotide
  source 1..451: mol_type = other DNA

SEQ ID NO: 840 - DNA, 546 bp, synthetic construct
  misc_feature 1..546: note = Synthetic polynucleotide
  source 1..546: mol_type = other DNA
aaaatatatacccagaatgttatcaattcttaccacctgcagtattatcaccctcagccaaactaacatcctctcttgtattatttttatattgcctcttagctgatttccctgcctataaccgaccccctacaccggtctgctctcagcacaacagccagagatatcctggttctggggctgctggtatggacgcttattgctggaactgagtacttccgggtccccgcatttggctgggtcatgtttgtagctgtattttactgggtcctcaccgtcttcttcctcattatctacataacaatgacctacaccaggattccccaggtgccctggacaacagtgggcctgtgctttaacggcagtgccttcgtcttgtacctctctgccgctgttgtagatgcatcttccgtctcccctgagagggacagtcacaacttcaacagctgggcggcctcatcgttctttgccttcctggtcaccatctgctacgctggaaatacatatttcagttttatagcatggagatccaggaccatacagtga

SEQ ID NO: 841 - DNA, 818 bp, synthetic construct
  misc_feature 1..818: note = Synthetic polynucleotide
  source 1..818: mol_type = other DNA
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaa

SEQ ID NO: 842 - DNA, 881 bp, synthetic construct
  misc_feature 1..881: note = Synthetic polynucleotide
  source 1..881: mol_type = other DNA
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaa

SEQ ID NO: 843 - DNA, 818 bp, synthetic construct; identical to SEQ ID NO: 841
  misc_feature 1..818: note = Synthetic polynucleotide
  source 1..818: mol_type = other DNA

SEQ ID NO: 844 - DNA, 738 bp, synthetic construct
  misc_feature 1..738: note = Synthetic polynucleotide
  source 1..738: mol_type = other DNA
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagaccc

SEQ ID NO: 845 - DNA, 1557 bp, synthetic construct
  misc_feature 1..1557: note = Synthetic polynucleotide
  source 1..1557: mol_type = other DNA
atagctttgatatttttccccttcaaagctcatgttgaaatttgatttccaaattggagatggggcctagtgagaggtatttgggttataggggtggatcactcatgaatggcttggagccctccgtgtggtactgagtaagttcttgctctattagtttatgtgagagttgactgttttagaaagcctggcacctccacccatctctcttcctccctctctcaccatgtgacacatctgcccccacttcaccttctgccatgagtaaaagcttcctgaggctctcaccagaagtagatgatagtgctatgcttcttgtacagcctgcagaactgtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctcacagctcgtgcctcagtactgagggtatggaggaaaaggcagtcagtcagtgtctaaaaatgacgcacgcaagagacgctcggggaagatgtagctggacctctgagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcatag

SEQ ID NO: 846 - DNA, 1449 bp, synthetic construct
  misc_feature 1..1449: note = Synthetic polynucleotide
  source 1..1449: mol_type = other DNA
atagctttgatatttttccccttcaaagctcatgttgaaatttgatttccaaattggagatggggcctagtgagaggtatttgggttataggggtggatcactcatgaatggcttggagccctccgtgtggtactgagtaagttcttgctctattagtttatgtgagagttgactgttttagaaagcctggcacctccacccatctctcttcctccctctctcaccatgtgacacatctgcccccacttcaccttctgccatgagtaaaagcttcctgaggctctcaccagaagtagatgatagtgctatgcttcttgtacagcctgcagaactgtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcatag

SEQ ID NO: 847 - DNA, 789 bp, synthetic construct
  misc_feature 1..789: note = Synthetic polynucleotide
  source 1..789: mol_type = other DNA
atagctttgatatttttccccttcaaagctcatgttgaaatttgatttccaaattggagatggggcctagtgagaggtatttgggttataggggtggatcactcatgaatggcttggagccctccgtgtggtactgagtaagttcttgctctattagtttatgtgagagttgactgttttagaaagcctggcacctccacccatctctcttcctccctctctcaccatgtgacacatctgcccccacttcaccttctgccatgagtaaaagcttcctgaggctctcaccagaagtagatgatagtgctatgcttcttgtacagcctgcagaactgtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctcacagctcgtgcctcagtactgagggtatggaggaaaaggcagtcagtcagtgtctaaaaatgacgcacgcaagagacgctcggggaagatgtagctggacctctgagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctc

SEQ ID NO: 848 - DNA, 904 bp, synthetic construct
  misc_feature 1..904: note = Synthetic polynucleotide
  source 1..904: mol_type = other DNA
agaaagggatgtggtataatgggaagagctttggctttacagtctggctaatatttccagtgaaatctcagactctccagtttactggggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattag

SEQ ID NO: 849 - DNA, 430 bp, synthetic construct
  misc_feature 1..430: note = Synthetic polynucleotide
  source 1..430: mol_type = other DNA
agaaagggatgtggtataatgggaagagctttggctttacagtctggctaatatttccagtgaaatctcagactctccagtttactggggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcgagatcggagttctttaattag

SEQ ID NO: 850 - DNA, 904 bp, synthetic construct; identical to SEQ ID NO: 848
  misc_feature 1..904: note = Synthetic polynucleotide
  source 1..904: mol_type = other DNA

SEQ ID NO: 851 - DNA, 1595 bp, synthetic construct
  misc_feature 1..1595: note = Synthetic polynucleotide
  source 1..1595: mol_type = other DNA
tgcagccgaatttgcctcagggctaccagcgcggtggagggttgggggtggggagaattttgcagaaacctctttgctcctctggtaggcatttgaaaacgtggcttgggtcaggcacaggcgcccccacccgccgggtcccaggtggtcttcgattttcctttgcattgatggataggtcactcgttccccccttgcaccggcacatgcctggacaccaccgtttctttcgctgtcgcccggtttgcctccggtgacacacgttcacaccatctgctgtgggatacgccagtgccattcgtgttcacatggtctccacctcgcaatctcccctgttcttgtttgcacgagtcctgtaaagcgcggtcggctttcctgagccccagggcttttagaagaggggtaggccactgctctttcaaaggaggagggaggcagagggttgaaggatcagtgaatttgcagcggacacttggcctcgagacctatgggatcattcttggctgcagcgaggccctgcctgcctcagcgcatgtggcgagcccatcctatctcactcagtgggggccgaaatgggatctgaaggggtgtcctgagaacacagcaggcgtcctgaagctccccctccctccctcggtggaagtcagctcaaggagttcctgaggacaggactcctgggggtttggccctgggacaggacaagacacccacggtccggtctcccaagccgccacaaactggagcccggatccagccgccgccgcggctgcagcaggaggctcgctgccgccgcgctgcggtggcgttatttaaaggggacgcagcctgaccgccaggagcggagcgccagtcgggcgggccaatgcgcatgcgcgaggcgcgagcctcttctcccgtcacagtggttcccacggttgtcttagaaaccagtccccgaggcttggcaaagcaggagcccttcgtggcagtgcttgtgtgtcggagctctgaggctccggcctgacctctcctcggggtcgacgggaacgtctccggatgccaggactcgcaaagggctgacaagaatgaggaaatcccaggcggagtccgggggaggcagcacggcatcccagcctcagggctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtga

SEQ ID NO: 852 - DNA, 1433 bp, synthetic construct
  misc_feature 1..1433: note = Synthetic polynucleotide
  source 1..1433: mol_type = other DNA
tgcagccgaatttgcctcagggctaccagcgcggtggagggttgggggtggggagaattttgcagaaacctctttgctcctctggtaggcatttgaaaacgtggcttgggtcaggcacaggcgcccccacccgccgggtcccaggtggtcttcgattttcctttgcattgatggataggtcactcgttccccccttgcaccggcacatgcctggacaccaccgtttctttcgctgtcgcccggtttgcctccggtgacacacgttcacaccatctgctgtgggatacgccagtgccattcgtgttcacatggtctccacctcgcaatctcccctgttcttgtttgcacgagtcctgtaaagcgcggtcggctttcctgagccccagggcttttagaagaggggtaggccactgctctttcaaaggaggagggaggcagagggttgaaggatcagtgaatttgcagcggacacttggcctcgagacctatgggatcattcttggctgcagcgaggccctgcctgcctcagcgcatgtggcgagcccatcctatctcactcagtgggggccgaaatgggatctgaaggggtgtcctgagaacacagcaggcgtcctgaagctccccctccctccctcggtggaagtcagctcaaggagttcctgaggacaggactcctgggggtttggccctgggacaggacaagacacccacggtccggtctcccaagccgccacaaactggagcccggatccagccgccgccgcggctgcagcaggaggctcgctgccgccgcgctgcggtggcgttatttaaaggggacgcagcctgaccgccaggagcggagcgccagtcgggcgggccaatgcgcatgcgcgaggcgcgagcctcttctcccgtcacagtggttcccacggttgtcttagaaaccagtccccgaggcttggcaaagcaggagcccttcgtggcagtgcttgtgtgtcggagctctgaggctccggcctgacctctcctcggggtcgacgggaacgtctccggatgccaggactcgcaaagggctgacaagaatgaggaaatcccaggcggagtccgggggaggcagcacggcatcccagcctcagggctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 853 - DNA, 649 bp, synthetic construct
  misc_feature 1..649: note = Synthetic polynucleotide
  source 1..649: mol_type = other DNA
cagggctgatgcctgtgtttgtgtgtgttgttcactgctctatggtgcctgggccagggggaatgagatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaa

SEQ ID NO: 854 - DNA, 649 bp, synthetic construct; identical to SEQ ID NO: 853
  misc_feature 1..649: note = Synthetic polynucleotide
  source 1..649: mol_type = other DNA

SEQ ID NO: 855 - DNA, 425 bp, synthetic construct
  misc_feature 1..425: note = Synthetic polynucleotide
  source 1..425: mol_type = other DNA
cagggctgatgcctgtgtttgtgtgtgttgttcactgctctatggtgcctgggccagggggaatgagatcatcaatgctgtggtactgttgattttattgagtgccctggctgatccggatcagtataacttttcaagttctgaactgggaggtgactttgagttcatggatgatgccaaaattctttttaatctttcggcagacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatg

SEQ ID NO: 856 - DNA, 233 bp, synthetic construct
  misc_feature 1..233: note = Synthetic polynucleotide
  source 1..233: mol_type = other DNA
cctgtaattccagcattttgggaggctgaggtgggaggattgcttgagttcaagagttcaagaccagtctgggcaacatggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtga

SEQ ID NO: 857 - DNA, 233 bp, synthetic construct; identical to SEQ ID NO: 856
  misc_feature 1..233: note = Synthetic polynucleotide
  source 1..233: mol_type = other DNA

SEQ ID NO: 858 - DNA, 233 bp, synthetic construct; identical to SEQ ID NO: 856
  misc_feature 1..233: note = Synthetic polynucleotide
  source 1..233: mol_type = other DNA

SEQ ID NO: 859 - DNA, 233 bp, synthetic construct; identical to SEQ ID NO: 856
  misc_feature 1..233: note = Synthetic polynucleotide
  source 1..233: mol_type = other DNA

SEQ ID NO: 860 - DNA, 375 bp, synthetic construct
  misc_feature 1..375: note = Synthetic polynucleotide
  source 1..375: mol_type = other DNA
ggccgagcgcggtggctcaggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtag

SEQ ID NO: 861 - DNA, 375 bp, synthetic construct; identical to SEQ ID NO: 860
  misc_feature 1..375: note = Synthetic polynucleotide
  source 1..375: mol_type = other DNA

SEQ ID NO: 862 - DNA, 255 bp, synthetic construct
  misc_feature 1..255: note = Synthetic polynucleotide
  source 1..255: mol_type = other DNA
ggccgagcgcggtggctcaggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgatagtgcctcccctccctgttccccaccaggcactgcaacatggtgctggagaacgtga

SEQ ID NO: 863 - DNA, 1389 bp, synthetic construct
  misc_feature 1..1389: note = Synthetic polynucleotide
  source 1..1389: mol_type = other DNA
cccgtgggatttttaatagatatctcaagcttagcacacccagggctcacctcctgcctcttcctctccaaacctgctcttcctatagtatttccagcagcagatctgtccttccagatgtttaggccagaaatcttgggctcttttttgagcccctgttttctctaacatctcagatatgacttgttagcaaatcttgtagcctgtacttcagagtctactgtgaatcctatcctttctcaccatgtctgctgcatgctggtccaggcagtagtctcactcctagctcatttaggtgactttataactagtttctctgcttgtttgttccccttcaggctcttctcaacacaggagtcagagtggggtgatcctgctccaacagaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagtaattttgtttgccgaagtgacccccacaacgatgcgtctcctggatgggctgatgtttcagacaccgcaggaaatgggcttaatagtgatcgcggcccggcagaccgagggcaaaggacggggagggaatgtgtggctgagccctgtgggatgtgctctttctactctgctcatctccattccactgagatcccagctgggacagaggatcccgtttgtccagcatctgatgtccgtggctgtcgtggaagcagtgaggtccattcccgagtatcaggatatcaacttacgagtgaagtggcccaacgatatttattacagtgacctcatgaagatcggcggagttctggttaactcaacactcatgggagaaacattttatatacttattggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaa

SEQ ID NO: 864 - DNA, 1389 bp, synthetic construct; identical to SEQ ID NO: 863
  misc_feature 1..1389: note = Synthetic polynucleotide
  source 1..1389: mol_type = other DNA

SEQ ID NO: 865 - DNA, 2094 bp, synthetic construct
  misc_feature 1..2094: note = Synthetic polynucleotide
  source 1..2094: mol_type = other DNA
tgacatggtttagctgggtctgcacccaaatctcaactttaattgtatctcccagaattcccatgtgttgtgggagggacccagggggaggtaattgaatcacgggggccggtctttcccgtgttattctcgtgatagtgaataggtctcatgagatctgacgggtttgtctggggtttccgcttttgcttcttcctcattttctcttgcgctgccatgtaagaactgcctttcacctcccacaatgattctgaggcctccccagacatgtggaattaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagaccctagctaacatattatggagagaagaaggtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaa

SEQ ID NO: 866 - DNA, 2094 bp, synthetic construct; identical to SEQ ID NO: 865
  misc_feature 1..2094: note = Synthetic polynucleotide
  source 1..2094: mol_type = other DNA

SEQ ID NO: 867 - DNA, 2094 bp, synthetic construct; identical to SEQ ID NO: 865
  misc_feature 1..2094: note = Synthetic polynucleotide
  source 1..2094: mol_type = other DNA

SEQ ID NO: 868 - DNA, 2067 bp, synthetic construct
  misc_feature 1..2067: note = Synthetic polynucleotide
  source 1..2067: mol_type = other DNA
tgacatggtttagctgggtctgcacccaaatctcaactttaattgtatctcccagaattcccatgtgttgtgggagggacccagggggaggtaattgaatcacgggggccggtctttcccgtgttattctcgtgatagtgaataggtctcatgagatctgacgggtttgtctggggtttccgcttttgcttcttcctcattttctcttgcgctgccatgtaagaactgcctttcacctcccacaatgattctgaggcctccccagacatgtggaattaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagacccgtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaa

SEQ ID NO: 869 - DNA, 566 bp, synthetic construct
  misc_feature 1..566: note = Synthetic polynucleotide
  source 1..566: mol_type = other DNA
gcttagtgcacaccctggcatatggtaaatactacatagccacgatggccctgatcacagcctccactgcgttgaccatcatggtgatgaatatccacttctgtggggccgaggcccggccggtgccacactgggccagggtggtcatcctgaaatacatgtccagggtcttgtttgtctatgatgtgggtgaaagctgcctcagcccgcaccacagtagagagcgggaccacctcacgaaagtttatagcaaactcccagagtctaacctgaaagcagccaggaacaaagacctttccagaaagaaggacatgaacaaacgcttaaagaacgacctgggctgccagggtaagaaccctcaggaggccgagagttactgtgcacagtacaaagtgctgacgaggaatattgagtacatcgccaagtgcctcaaagaccacaaggccaccaattccaaggggagtgaatggaagaaggtggcgaaagtcatagaccgattcttcatgtggatttttttcattatggtgtttgtgatgactattttgatcatagcaagagcggattag

SEQ ID NO: 870 - DNA, 1593 bp, synthetic construct
  misc_feature 1..1593: note = Synthetic polynucleotide
  source 1..1593: mol_type = other DNA
tggtgcaggggaggttgtgtgagggctacctgggcggtggagctttggccttggggtgaattttgcagaaacctatttgttgctctggcaggaatttcaaattttggatccggtcagtcacaagccgcctcctgtttcccaagtgttctttaatttttcattgctgtgatggaaatgtcacttgaccctcccttccaccgggcacatgcctagacagcatcgtttgtttcgccgtcgccccacattcctctggttacacacattcaagccatctgctgtgggattggtcagtgccacacgtcaacgcatggtctccacctgggattcgcccctgttcctgtttgcacgtgtcctgtaaattgcgattggcttccagagccccagggcttttagaagcccggcaggccagtgttctttaaaaggagaagggaggcagagggctgatggatcagtgaaatttcagctgacagcatgccttgagacccatgggatcattgtgtgctgcagcgaggccctgcctgcctcaccagatgtggtgagcccatcctatctcactcggtgggggccaaaatcagatctgaaggggagtcctgagaacacagcaggcgtcctgaagctccccctccctccctcggtggaagtcggctcaaggagtttctgaggacaggactcctgggggtttggccgtgggacagaagaagacacccgcggtcccctctcccacgccgacccaaactggagcccggatccagccgccgccgcggctgcagcaggagcctccctgccgccgcgctgcggtggcgttatttaaaggggacgcagcctgaccgccaggagcggagcgccagtcgggtgggccaatgcgcatgcgcgaggcgcgagcgccttctcccgtcacagtggttcccacggttgtcttagaaaccagtccccgaggcttggcaaagcaggagcgctccgtggcagtgcttgtgtgtcggggctctgaggctccggcctgacctctcctcggggtcgacgggaaggtctccggatgccaggactcgcaaagggccgaccagaatgaggaaatcccaggcggagtccgggggaggcagcacggcatcccagcctcagggctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtga

SEQ ID NO: 871 - DNA, 1431 bp, synthetic construct
  misc_feature 1..1431: note = Synthetic polynucleotide
  source 1..1431: mol_type = other DNA
tggtgcaggggaggttgtgtgagggctacctgggcggtggagctttggccttggggtgaattttgcagaaacctatttgttgctctggcaggaatttcaaattttggatccggtcagtcacaagccgcctcctgtttcccaagtgttctttaatttttcattgctgtgatggaaatgtcacttgaccctcccttccaccgggcacatgcctagacagcatcgtttgtttcgccgtcgccccacattcctctggttacacacattcaagccatctgctgtgggattggtcagtgccacacgtcaacgcatggtctccacctgggattcgcccctgttcctgtttgcacgtgtcctgtaaattgcgattggcttccagagccccagggcttttagaagcccggcaggccagtgttctttaaaaggagaagggaggcagagggctgatggatcagtgaaatttcagctgacagcatgccttgagacccatgggatcattgtgtgctgcagcgaggccctgcctgcctcaccagatgtggtgagcccatcctatctcactcggtgggggccaaaatcagatctgaaggggagtcctgagaacacagcaggcgtcctgaagctccccctccctccctcggtggaagtcggctcaaggagtttctgaggacaggactcctgggggtttggccgtgggacagaagaagacacccgcggtcccctctcccacgccgacccaaactggagcccggatccagccgccgccgcggctgcagcaggagcctccctgccgccgcgctgcggtggcgttatttaaaggggacgcagcctgaccgccaggagcggagcgccagtcgggtgggccaatgcgcatgcgcgaggcgcgagcgccttctcccgtcacagtggttcccacggttgtcttagaaaccagtccccgaggcttggcaaagcaggagcgctccgtggcagtgcttgtgtgtcggggctctgaggctccggcctgacctctcctcggggtcgacgggaaggtctccggatgccaggactcgcaaagggccgaccagaatgaggaaatcccaggcggagtccgggggaggcagcacggcatcccagcctcagggctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 872 - DNA, 1002 bp, synthetic construct
  misc_feature 1..1002: note = Synthetic polynucleotide
  source 1..1002: mol_type = other DNA
tgatatggtttggctgtgtgtctccacccaagtctcatcttgtagctcccataattcccaagtgttgtgggaggaacccggtgggagatgattgaatcatgggggcgggtctttcccgtgctgttctggtgatactgaatgggtctcacgagatctgatggtttcgaaaacaggagtttctctgcacaagctctctgtttgcctgctgtcgtccacataagatgtgacttgctcctgcttgccttcctccatgattgtgaggcctccccagccacgtggaactttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtag

SEQ ID NO: 873 - DNA, 897 bp, synthetic construct
  misc_feature 1..897: note = Synthetic polynucleotide
  source 1..897: mol_type = other DNA
tgatatggtttggctgtgtgtctccacccaagtctcatcttgtagctcccataattcccaagtgttgtgggaggaacccggtgggagatgattgaatcatgggggcgggtctttcccgtgctgttctggtgatactgaatgggtctcacgagatctgatggtttcgaaaacaggagtttctctgcacaagctctctgtttgcctgctgtcgtccacataagatgtgacttgctcctgcttgccttcctccatgattgtgaggcctccccagccacgtggaactttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgat

SEQ ID NO: 874 - DNA, 836 bp, synthetic construct
  misc_feature 1..836: note = Synthetic polynucleotide
  source 1..836: mol_type = other DNA
tgatatggtttggctgtgtgtctccacccaagtctcatcttgtagctcccataattcccaagtgttgtgggaggaacccggtgggagatgattgaatcatgggggcgggtctttcccgtgctgttctggtgatactgaatgggtctcacgagatctgatggtttcgaaaacaggagtttctctgcacaagctctctgtttgcctgctgtcgtccacataagatgtgacttgctcctgcttgccttcctccatgattgtgaggcctccccagccacgtggaactttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgc

SEQ ID NO: 875 - DNA, 528 bp, synthetic construct
  misc_feature 1..528: note = Synthetic polynucleotide
  source 1..528: mol_type = other DNA
tgatatggtttggctgtgtgtctccacccaagtctcatcttgtagctcccataattcccaagtgttgtgggaggaacccggtgggagatgattgaatcatgggggcgggtctttcccgtgctgttctggtgatactgaatgggtctcacgagatctgatggtttcgaaaacaggagtttctctgcacaagctctctgtttgcctgctgtcgtccacataagatgtgacttgctcctgcttgccttcctccatgattgtgaggcctccccagccacgtggaactttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaacc

SEQ ID NO: 876 - DNA, 549 bp, synthetic construct
  misc_feature 1..549: note = Synthetic polynucleotide
  source 1..549: mol_type = other DNA
cttaggtgccatagtcagccaaaagcagtgtgtgggccttgtgttgaatctcccttcaaacagaccaactgttggaggacattttagagacagagaaaactgaacacaggtgttggatgatgataaggaagtctcgttgattctgttaggaaagaaatgctgtcctcgctcagccggctcctgggcctcatgaggccatcatctctcaggcaatacctggactctgtgcccttgccaccctgccaggagcaacagccaaaggctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccatgctcaaggacctggctacccagacctacatccgttggcaggagctgctgacccactgccagccccaggcccagtatttcagcccctggaaagacatctaa

SEQ ID NO: 877 - DNA, 549 bp, synthetic construct; identical to SEQ ID NO: 876
  misc_feature 1..549: note = Synthetic polynucleotide
  source 1..549: mol_type = other DNA

SEQ ID NO: 878 - DNA, 549 bp, synthetic construct; identical to SEQ ID NO: 876
  misc_feature 1..549: note = Synthetic polynucleotide
  source 1..549: mol_type = other DNA

SEQ ID NO: 879 - DNA, 1795 bp, synthetic construct
  misc_feature 1..1795: note = Synthetic polynucleotide
  source 1..1795: mol_type = other DNA
ctctccctctccctcctcgccctctccctctccctctccccacggtctccctctccctctctttccatggtctccctctgatgccgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcactgtgttggccgggctggtctccagctcctaaacgcgagtgatccgccagcctcggcctcccgaggtgccgggattgcagacggagtctcgttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcatctctgcctggccgcccatcgtctgggatgtgaggagcccctctgcctggctgcccagtctggaaagtgaggagcgtctctgaccggccgccatcccatctaggaagtgaggagagcctcttcccggccgccatcccatctaggaagtgaggagcgtctctgcccggccacccatcgtctgagatgtggggagcgcctctgctccaccgccccgtctgggatgtgaggaccgcctctgcccggccgcgaccccgtctgggaggtgaggagcgtctctgcctggccgccccgtctgagaagtgaggagaccctccgcccggcagccgcccagtctgagaagtccaggacctacagctggaacgggagatggcactggccaccaaccggagcctggcagagcggaacttggagttccagggtcccctggagatcagccgctcaaacctctcggatagataccaggagctccggaagctcgtggagcggtgccaggagcagaaggcaaagctggagaaattttcttcagcactgcagccagggaccttgttagaccttctgcaggtggaaggcatgaagatcgaagaagagtccgaggccatggctgagaagttcctggagggcgaggtgcccctggaaacgttcctggagaatttttcctccatgaggatgctgtcccacctgcgccgggttcgcgtggaaaagctccaggaagtggtgaggaagcccagggcttcccaggagctggccggcgatgcccctccaccccgtccaccacccccggtgcgcccagtcccccagggaacaccccctgtggttgaagagcagccgcagccaccattagccatgcctccctaccctttgccctacagcccatcccccagcctgcctgtgggccccactgcccatggagccctgccaccggcccctttcccagtagtgtcccagccctccttctacagcgggcctctgggccccacttacccggcagcccagcttggacccaggggtgctgcgggttactcctggtccccacagaggagcatgccaccccggccgggctatcctgggaccccaatgggtgcctctgggcctgggtaccccttgcggggaggcagggcccccagtcctggttatcctcaacagtccccataccccgcaacaggaggaaaacctccctacccaatacagcctcagctccccagctttccaggccagccccagccctcagtgcccctgcagcccccttatccccccgggcccgcccctccctatgggttcccaccaccgccggggcctgcctggcctgggtattag

SEQ ID NO: 880 - DNA, 1171 bp, synthetic construct
  misc_feature 1..1171: note = Synthetic polynucleotide
  source 1..1171: mol_type = other DNA
ctctccctctccctcctcgccctctccctctccctctccccacggtctccctctccctctctttccatggtctccctctgatgccgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcactgtgttggccgggctggtctccagctcctaaacgcgagtgatccgccagcctcggcctcccgaggtgccgggattgcagacggagtctcgttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcatctctgcctggccgcccatcgtctgggatgtgaggagcccctctgcctggctgcccagtctggaaagtgaggagcgtctctgaccggccgccatcccatctaggaagtgaggagagcctcttcccggccgccatcccatctaggaagtgaggagcgtctctgcccggccacccatcgtctgagatgtggggagcgcctctgctccaccgccccgtctgggatgtgaggaccgcctctgcccggccgcgaccccgtctgggaggtgaggagcgtctctgcctggccgccccgtctgagaagtgaggagaccctccgcccggcagccgcccagtctgagaagtccaggacctacagctggaacgggagatggcactggccaccaaccggagcctggcagagcggaacttggagttccagggtcccctggagatcagccgctcaaacctctcggatagataccaggagctccggaagctcgtggagcggtgccaggagcagaaggcaaagctggagaaattttcttcagcactgcagccagggaccttgttagaccttctgcaggtggaaggcatgaagatcgaagaagagtccgaggccatggctgagaagttcctggagggcgaggtgcccctggaaacgttcctggagaatttttcctccatgaggatgctgtcccacctgcgccgggtt

SEQ ID NO: 881 - DNA, 507 bp, synthetic construct
  misc_feature 1..507: note = Synthetic polynucleotide
  source 1..507: mol_type = other DNA
cagggagttagcagggggctcatggttaagagtgtgaactacggcttagacctacagggttccctgcccagctcctccacaaaccagctgtgcaaccctagacaagtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctga

SEQ ID NO: 882 - DNA, 507 bp, synthetic construct; identical to SEQ ID NO: 881
  misc_feature 1..507: note = Synthetic polynucleotide
  source 1..507: mol_type = other DNA

SEQ ID NO: 883 - DNA, 507 bp, synthetic construct; identical to SEQ ID NO: 881
  misc_feature 1..507: note = Synthetic polynucleotide
  source 1..507: mol_type = other DNA

SEQ ID NO: 884 - DNA, 507 bp, synthetic construct; identical to SEQ ID NO: 881
  misc_feature 1..507: note = Synthetic polynucleotide
  source 1..507: mol_type = other DNA

SEQ ID NO: 885 - DNA, 507 bp, synthetic construct; identical to SEQ ID NO: 881
  misc_feature 1..507: note = Synthetic polynucleotide
  source 1..507: mol_type = other DNA

SEQ ID NO: 886 - DNA, 507 bp, synthetic construct; identical to SEQ ID NO: 881
  misc_feature 1..507: note = Synthetic polynucleotide
  source 1..507: mol_type = other DNA

SEQ ID NO: 887 - DNA, 507 bp, synthetic construct; identical to SEQ ID NO: 881
  misc_feature 1..507: note = Synthetic polynucleotide
  source 1..507: mol_type = other DNA

SEQ ID NO: 888 - DNA, 507 bp, synthetic construct; identical to SEQ ID NO: 881
  misc_feature 1..507: note = Synthetic polynucleotide
  source 1..507: mol_type = other DNA

SEQ ID NO: 889 - DNA, 507 bp, synthetic construct; identical to SEQ ID NO: 881
  misc_feature 1..507: note = Synthetic polynucleotide
  source 1..507: mol_type = other DNA

SEQ ID NO: 890 - DNA, 507 bp, synthetic construct; identical to SEQ ID NO: 881
  misc_feature 1..507: note = Synthetic polynucleotide
  source 1..507: mol_type = other DNA

SEQ ID NO: 891 - DNA, 343 bp, synthetic construct
  misc_feature 1..343: note = Synthetic polynucleotide
  source 1..343: mol_type = other DNA
tgatatgttttgaatttgtgtccctacccaaatatcatgtcaaattgtcatccctaatgttggaggaggggcctggtgagaggtgattggatcacagggagggacttccccttgcttttctctcaataatgagttctcacaagatctggttcttcagaagtgtgtggcacctcccctactctctctttctccttctccggccatgcaagacatatctgcttctccttcaccttccactatgattacaaaccttggaaatcaagaaagttctggaatgatgaagctgttcatgccaagaccgaaagtgctggcccagtatgagtccattcagttcatgccgtga

SEQ ID NO: 892 - DNA, 343 bp, synthetic construct; identical to SEQ ID NO: 891
  misc_feature 1..343: note = Synthetic polynucleotide
  source 1..343: mol_type = other DNA

SEQ ID NO: 893 - DNA, 838 bp, synthetic construct
  misc_feature 1..838: note = Synthetic polynucleotide
  source 1..838: mol_type = other DNA
tgatatggtttggctgtgtccccacccaaatctcattttgaattgtactttccataatccccacatgttgtgggagggacctggtgggaagtaattgaatcatcggggtggtttcctccatgccattctcatgatagtgagtaagttctcacaagatctgagggttttataagaggcttttccctttgaacttggatctcattcttctccgtcctgccgccctgtgaagaaggatttgtttgcttccccttctgccatggttataagtttcctgaggcttcctcagccctgcagaactgtctcagcattagagaggcagatctttgacttccttggtttccagtgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaaggacaccgatctaatgacattcaatatctctgtacatcggtcatggtggagagaacatgggcctggttgtgtcagaagagtgctgcctccctcagcccatggcatgatggacgattacacgtacgtctctgtcacaggctgcatcgttgacttccagtacctggaggtcatccacagtgctgtccaaatactactctctttggtgggttttgtgtatgcctgttatgtgatcagtatttccatggaagaagaagacacatattcatgtgatctgcaagtatgcaaacatctttttatccagatgctgcaaattattgaataa

SEQ ID NO: 894 - DNA, 547 bp, synthetic construct
  misc_feature 1..547: note = Synthetic polynucleotide
  source 1..547: mol_type = other DNA
tgatatggtttggctgtgtccccacccaaatctcattttgaattgtactttccataatccccacatgttgtgggagggacctggtgggaagtaattgaatcatcggggtggtttcctccatgccattctcatgatagtgagtaagttctcacaagatctgagggttttataagaggcttttccctttgaacttggatctcattcttctccgtcctgccgccctgtgaagaaggatttgtttgcttccccttctgccatggttataagtttcctgaggcttcctcagccctgcagaactgtctcagcattagagaggcagatctttgacttccttggtttccagtgggcgcctattcttggaaattttctacacataatagttgtcatattgggtttgtttgggaccattcagtacagacctcgatacataatggtggacaccgatctaatgacattcaatatctctgtacatcggtcatggtggagagaacatgggcctggttgtgtcagaagagtgctgcctccctcagcccatggcatgatggac

SEQ ID NO: 895 - DNA, 838 bp, synthetic construct; identical to SEQ ID NO: 893
  misc_feature 1..838: note = Synthetic polynucleotide
  source 1..838: mol_type = other DNA

SEQ ID NO: 896 - DNA, 373 bp, synthetic construct
  misc_feature 1..373: note = Synthetic polynucleotide
  source 1..373: mol_type = other DNA
tttttaaaagccatttctcttgatgtgcactgcctcagctgaccgtcctgggtgtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 897 - DNA, 394 bp, synthetic construct
  misc_feature 1..394: note = Synthetic polynucleotide
  source 1..394: mol_type = other DNA
aaattagctaggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatc

SEQ ID NO: 898 - DNA, 1194 bp, synthetic construct
  misc_feature 1..1194: note = Synthetic polynucleotide
  source 1..1194: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtaagtttcccgaggcctcccgtgccatgccttctgtacagcctgcagaactgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 899 - DNA, 1116 bp, synthetic construct
  misc_feature 1..1116: note = Synthetic polynucleotide
  source 1..1116: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtaagtttcccgaggcctcccgtgccatgccttctgtacagcctgcagaactgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 900 - DNA, 1194 bp, synthetic construct; identical to SEQ ID NO: 898
  misc_feature 1..1194: note = Synthetic polynucleotide
  source 1..1194: mol_type = other DNA

SEQ ID NO: 901 - DNA, 824 bp, synthetic construct
  misc_feature 1..824: note = Synthetic polynucleotide
  source 1..824: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtaagtttcccgaggcctcccgtgccatgccttctgtacagcctgcagaactgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 902 - DNA, 642 bp, synthetic construct
  misc_feature 1..642: note = Synthetic polynucleotide
  source 1..642: mol_type = other DNA
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtaagtttcccgaggcctcccgtgccatgccttctgtacagcctgcagaactgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 903 - DNA, 473 bp, synthetic construct
  misc_feature 1..473: note = Synthetic polynucleotide
  source 1..473: mol_type = other DNA
cccacatgcagccaacgggcaaaatgtggtttcccttatccaccagggtgagcccttcctgaaatgtttatcaagagtttctttttctctcttcagcagcttgttggtgtagtcacctctcattgtggatttttaatcaatttgatctaaacatggaaaagcaaattttactttccacagatgggcaggatgtagtgaaagtccagagaaggttctcaccaaatgtgtgcagctcggaagaaaaaggcatgacagcaagcgctgtggcggctttgatcctcatgacgtcctccatcatgtcggtcgtggggtccctgtacctggcctacattctgtactttgtgctgaaggagttctgcatcatctgcatcgtcacgtacgtgctgaacttccttcttctcattatcaactacaaacgactagtttacttgaacgaggcctggaagcggcagctgcaacccaagcaggactga

SEQ ID NO: 904 - DNA, 586 bp, synthetic construct
  misc_feature 1..586: note = Synthetic polynucleotide
  source 1..586: mol_type = other DNA
cccacatgcagccaacgggcaaaatgtggtttcccttatccaccagggtgagcccttcctgaaatgtttatcaagagtttctttttctctcttcagcagcttgttggtgtagtcacctctcattgtggatttttaatcaatttgatctaaacatggaaaagcaaattttactttccacagatgggcaggatgtagtgaaagtccagagaaggttctcaccaaatgtgtgcagctcggaagaaaaaggcatgacagcaagcgctgtggcggctttgatcctcatgacgtcctccatcatgtcggtcgtggggtccctgtacctggcctacattctgtactttgtgctgaaggagttctgcatcatctgcatcgtcacgtacgtgctgaacttccttcttctcattatcaactacaaacgactagtttacttgaacgaggcctggaagcggcagctgcaacccaagcaggactgacgcccgacagactccaccctaacagtctcaagcccctttccattcagtttattttgcagcaggtttttattattattattattattattattcacaacagacactttccctaa

SEQ ID NO: 905 - DNA, 1737 bp, synthetic construct
  misc_feature 1..1737: note = Synthetic polynucleotide
  source 1..1737: mol_type = other DNA
aggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcgactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtga

SEQ ID NO: 906 - DNA, 284 bp, synthetic construct
  misc_feature 1..284: note = Synthetic polynucleotide
  source 1..284: mol_type = other DNA
aggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcgactattgcagatatcatccgaacatgtttgggacccaagtccatgatgaagatgcttttggacccaatgggaggcattgtgatgaccaatga

SEQ ID NO: 907 - DNA, 856 bp, synthetic construct
  misc_feature 1..856: note = Synthetic polynucleotide
  source 1..856: mol_type = other DNA
aggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcgactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagcc

SEQ ID NO: 908 - DNA, 802 bp, synthetic construct
  misc_feature 1..802: note = Synthetic polynucleotide
  source 1..802: mol_type = other DNA
aggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcgactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaacc

SEQ ID NO: 909 - DNA, 561 bp, synthetic construct
  misc_feature 1..561: note = Synthetic polynucleotide
  source 1..561: mol_type = other DNA
aggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcgactattgcagatatcatccgaacatgtttgggacccaagtccatgatgaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacatt

SEQ ID NO: 910 - DNA, 582 bp, synthetic construct
  misc_feature 1..582: note = Synthetic polynucleotide
  source 1..582: mol_type = other DNA
aggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcgactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgagtctcactctgtcaccatgctggagtgtggtggtgcgatcttggctcactgcaacctctgcctcccagcaggggaaatgctgtctgtagctgagcacttcctggagcagcagatgcacccaacagtggtgatcagtgcttaccgcaaggcattggatgatatgatcagcaccctaaag

SEQ ID NO: 911 - DNA, 681 bp, synthetic construct
  misc_feature 1..681: note = Synthetic polypeptide
  source 1..681: mol_type = other DNA
atgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacaggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgacgaggtcaggagttcaagaccagcctgaccaacatggtgaaaccccgtctctactaaaaatacaaaaaattagctgggcatggtggcatgcacctgtaatcccagctactcaggaggctgaggcaggagaatcgcttgaacccgggagccggaggttgcagtgagtcgagatcatgccactgcactccagcctgggcaacaagagtgagactccatctaaaaaaaaaaaaaaaaaaaaaaa

SEQ ID NO: 912 - DNA, 211 bp, synthetic construct
  misc_feature 1..211: note = Synthetic polypeptide
  source 1..211: mol_type = other DNA
atggctgcctttccccacaagattatatttttcctggtatgctctactttgacacatgtggctttctcagaaactccaggaggaatgcatcactgctgacatcttgactttaggacttctcacctccagaattgtaagataataaatttgtgttttgttaagtcactaagtttgtgacaattcattacaacagcaataagaaaatagtaca

SEQ ID NO: 913 - DNA, 856 bp, synthetic construct
  misc_feature 1..856: note = Synthetic polypeptide
  source 1..856: mol_type = other DNA
atggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggttactggttgcctagctataaattgaagtcttcctgggccacaggcctccatctctctgtcttgtttggccatgtggaatgtcttctggtgctactggaccacaatgctacaatcaactgtagacccaatgggaaaacccctcttcacgtggcttgtgaaatggccaatgtggattgtgttaagatcctctgtgatcgtggggcaaagctcaattgctactccttaagtggacacacagctttgcacttttgtacaactccaagttccattctctgtgccaagcaattggtttggagaggctcatggaagaccacgctttctagtccacttgaagttcagcaggcatatgactcttctagctaatgacatatgaacaaaagaaataagagtggcttccaggcttagacaatgaaaagtccatgaggaatttttaaagtcttcttctccccatgatattgtgatagtggggcaagcctcaggtagagatggcgaagccataagaccaaggcagcttggagccctgagaaatcaaatggagggccttgattctgaattgccccttggaactgcagtgcactatgtgacagtgagaaataaccttctgttgctctaagccactgaaatatgagtgtctttacaacagcataattaagtttattctgactaa

SEQ ID NO: 914 - DNA, 3388 bp, synthetic construct
  misc_feature 1..3388: note = Synthetic polypeptide
  source 1..3388: mol_type = other DNA
atgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagcctggcctctgcccaccactccccagaaacggcgctcgcctaggcc

SEQ ID NO: 915 - DNA, 3346 bp, synthetic construct
  misc_feature 1..3346: note = Synthetic polypeptide
  source 1..3346: mol_type = other DNA
atgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagcctggcctctgcccaccactccccagaaacggcgctcgcctaggcc

SEQ ID NO: 916 - DNA, 1396 bp, synthetic construct
  misc_feature 1..1396: note = Synthetic polypeptide
  source 1..1396: mol_type = other DNA
atggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggttactggttgcctagctataaattgaagtcttcctgggccacaggcctccatctctctgtcttgtttggccatgtggaatgtcttctggtgctactggaccacaatgctacaatcaactgtagacccaatgggaaaacccctcttcacgtggcttgtgaaatggccaatgtggattgtgttaagatcctctgtgatcgtggggcaaagctcaattgctactccttaagtggacacacagctttgcacttttgtacaactccaagttccattctctgtgccaagcaattggtttggagaggggcgaatgtgaacatgaagaccaacaaccaagatgaggagacgcccttgcacacggctgcccacttcggcctttcggagctggtggccttctacgtggaacacggggccatagtggacagcgtgaatgcccacatggagacccccctggccatcgccgcctactgggccctccgctttaaggagcaggagtacagcacggagcaccacctggtctgccgcatgctgcttgactacaaagccgaagtcaatgcccgagatgacgactttaaatctcccctccacaaggcagcctggaactgtgaccacgtgctcatgcacatgatgctggaagctggcgccgaagccaatctcatggatatcaacggctgtgctgccatccagtacgtgctgaaggtcacctccgtgcgccctgctgcccagcctgagatctgctaccagctcctgttgaaccatggggctgcccgaatataccctccacagttccataaggtgatacaggcctgccattcttgtcctaaagcaattgaagttgtagtcaatgcctatgaacacatcagatggaacacaaagtggagaagagctatccccgatgatgacttggagcaacttggatggagctggaggccattattctaagtgaagtaactcaggaatggaaagtgaaataccatatgttctcacttataagtgggagctaagcaatgaggatgcaaagacatccagagtgatataatggactatggggacttgcaaggggaagcttgagagtggggtgagggataaaagactacatattgggtacagtgtacactgctccagtgatgggtgcactaaaatctcaaaattcaccactaaagaatgtatccatgtaaccaaaaaccacctgtacccccaaaactattgaaat

SEQ ID NO: 917 - DNA, 351 bp, synthetic construct
  misc_feature 1..351: note = Synthetic polypeptide
  source 1..351: mol_type = other DNA
atggctgcctttccccacaagattatatttttcctggtatgctctactttgacacatgtggctttctcagagggaggcaggagggcccaagtcagagaagatgtgacaatggaagcagaagttagaatggtgcagtaaaagggccatgggccgaggaactcagacagcctgtagaagctggaaaaggtaaggaaattaattcttccttagaaactccaggaggaatgcatcactgctgacatcttgactttaggacttctcacctccagaattgtaagataataaatttgtgttttgttaagtcactaagtttgtgacaattcattacaacagcaataagaaaatagtaca

SEQ ID NO: 918 - DNA, 487 bp, synthetic construct
  misc_feature 1..487: note = Synthetic polypeptide
  source 1..487: mol_type = other DNA
atggccggcgcggcggcggagtcagggcgggagctgtggaccttcgcgggttcccgggacccgagcgcaccgcggctagcctacggctacggcccgggcagcctgcgcgagctgcgggcgcgcgagttcagccgcctggcagataccaagactattcaacgagggaaataacttcttcaataagtgatattgggacaactggatatcaacatgcaaaagaacgaacttggacccctacctcattctgcattcaaaaattaactcaatggatcaaatacctaaatatgaaacagctaaaagtataatattcttagagtaatatataagcataaatcactaggaccttgttgaattagacaataatttcttatgacaccaaaaatgcaacaacataaatagacaaattggattttatcaaacttaaaaagaacttgtatgtttcaatgaacaccatcaagaaagtgaaaggacaacccaccaaatgaga

SEQ ID NO: 919 - DNA, 500 bp, synthetic construct
  misc_feature 1..500: note = Synthetic polypeptide
  source 1..500: mol_type = other DNA
atgctgctgctggcggacatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggcacagtggctcacgcctgtaatcccagcactttgagaggccgaggtgggcggatcacctgaggtcaggagttcgagaccagcctgaccaacatggagaaaccccgtctctactaaaaatacaaaattagccaggcgtggtcatgcatgcctgtaatcccggctactcaggaggctgaagcaggagaatcacttgaacctgggagccgaaatcgcgccattgcactccagcctgggcaacaagagcgaaactccatctccaaaaaaaaaaaaa

SEQ ID NO: 920 - DNA, 2161 bp, synthetic construct; identical to SEQ ID NO: 288
  misc_feature 1..2161: note = Synthetic polypeptide
  source 1..2161: mol_type = other DNA

SEQ ID NO: 921 - DNA, 2140 bp, synthetic construct; identical to SEQ ID NO: 289
  misc_feature 1..2140: note = Synthetic polypeptide
  source 1..2140: mol_type = other DNA

SEQ ID NO: 922 - DNA, 529 bp, synthetic construct; identical to SEQ ID NO: 287
  misc_feature 1..529: note = Synthetic polypeptide
  source 1..529: mol_type = other DNA

SEQ ID NO: 923 - DNA, 276 bp, synthetic construct
  misc_feature 1..276: note = Synthetic polypeptide
  source 1..276: mol_type = other DNA
atgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagggcggctgctggcatatcacagagatgaggttctcaaaatgcaaagcagaaggtccagccaagagtcggtgcccaa

SEQ ID NO: 924 - DNA, 1420 bp, synthetic construct
  misc_feature 1..1420: note = Synthetic polypeptide
  source 1..1420: mol_type = other DNA
atgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcaggccaggcgcggtcgctcacacctgtaatcccagcactttgggaggccgaggtgagtggatcacgaggtcaggagatcgagacgatcctggctaacatggtgaaatcccgtctctactaaaaatacaaaaaattagccgggcgtggtggcaggcacctgtagtcccagctactcaggaggctgaggcagaagaatggcgtgaacccaggaggcagaggttgcagtgagctgagatcatgccactgcacttcagcctgggcgacagagcgagactatctcacaaaaaaaaaaa

SEQ ID NO: 925 - DNA, 1336 bp, synthetic construct
  misc_feature 1..1336: note = Synthetic polypeptide
  source 1..1336: mol_type = other DNA
atgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaagagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcaggccaggcgcggtcgctcacacctgtaatcccagcactttgggaggccgaggtgagtggatcacgaggtcaggagatcgagacgatcctggctaacatggtgaaatcccgtctctactaaaaatacaaaaaattagccgggcgtggtggcaggcacctgtagtcccagctactcaggaggctgaggcagaagaatggcgtgaacccaggaggcagaggttgcagtgagctgagatcatgccactgcacttcagcctgggcgacagagcgagactatctcacaaaaaaaaaaa

SEQ ID NO: 926 - DNA, 1069 bp, synthetic construct
  misc_feature 1..1069: note = Synthetic polypeptide
  source 1..1069: mol_type = other DNA
atggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcaggccaggcgcggtcgctcacacctgtaatcccagcactttgggaggccgaggtgagtggatcacgaggtcaggagatcgagacgatcctggctaacatggtgaaatcccgtctctactaaaaatacaaaaaattagccgggcgtggtggcaggcacctgtagtcccagctactcaggaggctgaggcagaagaatggcgtgaacccaggaggcagaggttgcagtgagctgagatcatgccactgcacttcagcctgggcgacagagcgagactatctcacaaaaaaaaaaa

SEQ ID NO: 927 - DNA, 1345 bp, synthetic construct
  misc_feature 1..1345: note = Synthetic polypeptide
  source 1..1345: mol_type = other DNA
atgaagtgggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcaggccaggcgcggtcgctcacacctgtaatcccagcactttgggaggccgaggtgagtggatcacgaggtcaggagatcgagacgatcctggctaacatggtgaaatcccgtctctactaaaaatacaaaaaattagccgggcgtggtggcaggcacctgtagtcccagctactcaggaggctgaggcagaagaatggcgtgaacccaggaggcagaggttgcagtgagctgagatcatgccactgcacttcagcctgggcgacagagcgagactatctcacaaaaaaaaaaa

SEQ ID NO: 928 - DNA, 117 bp, synthetic construct
  misc_feature 1..117: note = Synthetic polypeptide
  source 1..117: mol_type = other DNA
atggagaagcccctcttcccattagtgcctttgcattggtttggctttggctacacagcactggttgtttctggtgggatcgttggctatgtaaaaacagcagccctagcaaaccaa

SEQ ID NO: 929 - DNA, 51 bp, synthetic construct
  misc_feature 1..51: note = Synthetic polypeptide
  source 1..51: mol_type = other DNA
gtttctggtgggatcgttggctatgtaaaaacagcagccctagcaaaccaa

SEQ ID NO: 930 - DNA, 734 bp, synthetic construct
  misc_feature 1..734: note = Synthetic polypeptide
  source 1..734: mol_type = other DNA
atggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaataccaccggaggagcgtgagccccagggggcacggacttgtgtttttttctgctgtgtc

SEQ ID NO: 931 - DNA, 914 bp, synthetic construct
  misc_feature 1..914: note = Synthetic polypeptide
  source 1..914: mol_type = other DNA
atggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcaccttgggaggccaaggtgggaggattacttgagcctgggagatagaagctgcagtaagccgtgatcccacacaccactgcactccagcctgggtgagagcaagaccctgtcttaaaaaacaaacaaacagaaaaa

SEQ ID NO: 932 - DNA, 251 bp, synthetic construct
  misc_feature 1..251: note = Synthetic polypeptide
  source 1..251: mol_type = other DNA
atgcagtggcggctccaggtgaaccgcctccaggagctcatcgaccagctcgagtgcaaggccccccggctggaacccctgcgtgaagaggacctggccaaggggcctgacttgcaccttgggaggccaaggtgggaggattacttgagcctgggagatagaagctgcagtaagccgtgatcccacacaccactgcactccagcctgggtgagagcaagaccctgtcttaaaaaacaaacaaacagaaaaa

SEQ ID NO: 933 - DNA, 1016 bp, synthetic construct
  misc_feature 1..1016: note = Synthetic polypeptide
  source 1..1016: mol_type = other DNA
atggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggtgagggccgtggggccagggccccacaagggaggaccctcctggtatccaccagagccaggcccatgctggaggcccggcccacactctgtgccctcacaggccccccggctggaacccctgcgtgaagaggacctggccaaggggcctgacttgcaccttgggaggccaaggtgggaggattacttgagcctgggagatagaagctgcagtaagccgtgatcccacacaccactgcactccagcctgggtgagagcaagaccctgtcttaaaaaacaaacaaacagaaaaa

SEQ ID NO: 934 - DNA, 1284 bp, synthetic construct
  misc_feature 1..1284: note = Synthetic polypeptide
  source 1..1284: mol_type = other DNA
atggctgcacttcgtgacgctgagatacagaaggacgtgcagacctactacgggcaggtgctgaagagatcggcagacctccagaccaacggctgtgtcaccacagccaggccggtccccaagcacatccgggaagccttgcaaaatgtacacgaagaagtagccctaagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtggaagtggctgaaaagtatcttgactatcacatggaaaaatatggcttccaggcatctaatgtgacttttattcatggctacattgagaagttgggagaggctggaatcaagaatgagagccatgatattgttgtatcaaactgtgttattaaccttgtgcctgataaacaacaagtgcttcaggaggcatatcgggtgctgaagcatggtggggagttatatttcagtgacgtctatacgagccttgaactgccagaagaaatcaggacacacaaagttttatggggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggtctttggattataactcaaccaattgccaatcacaaaatctttgaatctgcctgtgacctggaaatccccacttccagttgtcccacgtttctggtctgaaccaatgtacatattatatgtattgattgatgtcttatgtctctctaaaatgtataaaaccaagttatagggtgaccactttgggcacatgtttgcagatctcctgagggctgtgtcacaggccattggtcacttatttggctcagaataaatctttttaagt

SEQ ID NO: 935 - DNA, 1727 bp, synthetic construct
  misc_feature 1..1727: note = Synthetic polypeptide
  source 1..1727: mol_type = other DNA
atggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggaagtgagcagcgtctctgcttggctgcccatcgtctgggatgtgaggagcccctgtgcctggccaccccatctgggaagtgaggcgcgcctctgcctggctgccaccacgtctaggaagtgaggagcgtctctgcctggccgcccatcatctgggatgtgaggagcccctctgcctggccgccccgtctgggaagtgaggagtgcctctgcccagtcgccccatctgggaggtgaggagcgcctctgcctggccgccccgtctgggagggttaaatggattaagggcggtgcaagatgtgctttgttaaacagatgcttgaaggcagcatgctcattaagagtcatcaccactccctaatctcaagtacccagggacacaaacagggccgaaggccgcagggacctctgcctaggaaaaccagagacctttgttctggtgtttatctgctggccttctctccactattatcctatgaccctgccacatccccctctctgagaaacacccaaaaatgatc

SEQ ID NO: 936 - DNA, 746 bp, synthetic construct
  misc_feature 1..746: note = Synthetic polypeptide
  source 1..746: mol_type = other DNA
atgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggaagtgagcagcgtctctgcttggctgcccatcgtctgggatgtgaggagcccctgtgcctggccaccccatctgggaagtgaggcgcgcctctgcctggctgccaccacgtctaggaagtgaggagcgtctctgcctggccgcccatcatctgggatgtgaggagcccctctgcctggccgccccgtctgggaagtgaggagtgcctctgcccagtcgccccatctgggaggtgaggagcgcctctgcctggccgccccgtctgggagggttaaatggattaagggcggtgcaagatgtgctttgttaaacagatgcttgaaggcagcatgctcattaagagtcatcaccactccctaatctcaagtacccagggacacaaacagggccgaaggccgcagggacctctgcctaggaaaaccagagacctttgttctggtgtttatctgctggccttctctccactattatcctatgaccctgccacatccccctctctgagaaacacccaaaaatgatc

SEQ ID NO: 937 - DNA, 767 bp, synthetic construct
  misc_feature 1..767: note = Synthetic polypeptide
  source 1..767: mol_type = other DNA
atgttaccatttctgtttttttccaccctgttttcttccatatttactgaagctcagaagcagtattgggtctgcaactcatccgatgcaagtatttcatacacctactgtgataaaatgcaatacccaatttcaattaatgttaacccctgtatagaattgaaaagatccaaaggattattgcacattttctacattccaaggagagatttaaagcaattatatttcaatctctatataactgtcaacaccatgaatcttccaaagcgcaaagaagttatttgccgaggatctgatgacgattactctttttgcagagctctgaagggagagactgtgaatacaacaatatcattctccttcaagggaataaaattttctaaggaagaagaagtaaaaactaaaaggcagaaatgaaatccacaggcagacagcccggcgtgctgcgccctgggcctggtaaagatcaacccctgaccgattccagacattgtatggaaaagcattgtgaaaatccctgtcctgttctgttctgattacctgtgcttgcagccccctgttacgtaccccctgcttgctcaatcgatcacgaccctcttacgcggacccccttagagttgtaagcccttaaaagggacaggaattgctcagtcggagagctcggtttttggagacgtgagtctgcccggtgcttccagctgaataaagccctttccttccacaacttggtgtctgaggggttgttgtctgcagctcattctgctaca

SEQ ID NO: 938 - DNA, 677 bp, synthetic construct
  misc_feature 1..677: note = Synthetic polypeptide
  source 1..677: mol_type = other DNA
atgttaccatttctgtttttttccaccctgttttcttccatatttactgaagctcagaagcagtattgggtctgcaactcatccgatgcaagtatttcatacacctactgtgggagagatttaaagcaattatatttcaatctctatataactgtcaacaccatgaatcttccaaagcgcaaagaagttatttgccgaggatctgatgacgattactctttttgcagagctctgaagggagagactgtgaatacaacaatatcattctccttcaagggaataaaattttctaaggaagaagaagtaaaaactaaaaggcagaaatgaaatccacaggcagacagcccggcgtgctgcgccctgggcctggtaaagatcaacccctgaccgattccagacattgtatggaaaagcattgtgaaaatccctgtcctgttctgttctgattacctgtgcttgcagccccctgttacgtaccccctgcttgctcaatcgatcacgaccctcttacgcggacccccttagagttgtaagcccttaaaagggacaggaattgctcagtcggagagctcggtttttggagacgtgagtctgcccggtgcttccagctgaataaagccctttccttccacaacttggtgtctgaggggttgttgtctgcagctcattctgctaca

SEQ ID NO: 939 - DNA, 733 bp, synthetic construct
  misc_feature 1..733: note = Synthetic polypeptide
  source 1..733: mol_type = other DNA
atggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 940 - DNA, 577 bp, synthetic construct
  misc_feature 1..577: note = Synthetic polypeptide
  source 1..577: mol_type = other DNA
atggaagataaggacagagagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 941 - DNA, 613 bp, synthetic construct
  misc_feature 1..613: note = Synthetic polypeptide
  source 1..613: mol_type = other DNA
atggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcagcacccccaggcccacgtggacatctacgagaaacagcctgtgccctttggcctggtgcgctttggtgtggcgcctgatcaccccgaggtgaagagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 942 - DNA, 601 bp, synthetic construct
  misc_feature 1..601: note = Synthetic polypeptide
  source 1..601: mol_type = other DNA
atgacaacctgcaaagcaggtgtcgtgcctcttgcttcacagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 943 - DNA, 736 bp, synthetic construct
  misc_feature 1..736: note = Synthetic polypeptide
  source 1..736: mol_type = other DNA
atggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 944 - DNA, 862 bp, synthetic construct
  misc_feature 1..862: note = Synthetic polypeptide
  source 1..862: mol_type = other DNA
atggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagagggtggaagccttgtgttctcagcccagggtcctgaactctcctgctctgtctggggaaggggaggacctgggggcgtcccagcctctctctctcgaccccaccagctgccaccctgttccccagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 945 - DNA, 709 bp, synthetic construct
  misc_feature 1..709: note = Synthetic polypeptide
  source 1..709: mol_type = other DNA
atggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 946 - DNA, 826 bp, synthetic construct
  misc_feature 1..826: note = Synthetic polypeptide
  source 1..826: mol_type = other DNA
atggcttcgcgctgctggcgctggtggggctggtcggcgtggcctcggacccggctgcctcccgccgggagcaccccgacctttgggggttcagatgaagtaagagaccctgcaaatgccaaagccttgaggaacaagagaaggaggatgcaggtgagggtgaagcttgggaagttccagcttctgttggatattcaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 947 - DNA, 580 bp, synthetic construct
  misc_feature 1..580: note = Synthetic polypeptide
  source 1..580: mol_type = other DNA
atggaagataaggacagagagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 948 - DNA, 1398 bp, synthetic construct
  misc_feature 1..1398: note = Synthetic polypeptide
  source 1..1398: mol_type = other DNA
atggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagggccaggtgaggtggctcacacctgtaatcccagcactttgggaggccaaggcaggcggatcacctgaggtcaggagttcaatactagcctggccaacatgatgaaaccccatctctactaaaaacacaaaaagtagccaggcgtggtggcacgtgcctgtaatcccagctactcgggaggctgaagcaggagaatcgcttgaacctgggaggtggaggttgcagtgagctgagatcgtgccaccgcactccagcctgggcaatggagccagactctgtctcaaaaaaataaataaataaataaaa

SEQ ID NO: 949 - DNA, 1302 bp, synthetic construct
  misc_feature 1..1302: note = Synthetic polypeptide
  source 1..1302: mol_type = other DNA
atggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagggccaggtgaggtggctcacacctgtaatcccagcactttgggaggccaaggcaggcggatcacctgaggtcaggagttcaatactagcctggccaacatgatgaaaccccatctctactaaaaacacaaaaagtagccaggcgtggtggcacgtgcctgtaatcccagctactcgggaggctgaagcaggagaatcgcttgaacctgggaggtggaggttgcagtgagctgagatcgtgccaccgcactccagcctgggcaatggagccagactctgtctcaaaaaaataaataaataaataaaa

SEQ ID NO: 950 - DNA, 960 bp, synthetic construct
  misc_feature 1..960: note = Synthetic polypeptide
  source 1..960: mol_type = other DNA
atgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 951 - DNA, 402 bp, synthetic construct
  misc_feature 1..402: note = Synthetic polypeptide
  source 1..402: mol_type = other DNA
atgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 952 - DNA, 1111 bp, synthetic construct
  misc_feature 1..1111: note = Synthetic polypeptide
  source 1..1111: mol_type = other DNA
gacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgagtcacccagagactgctatgggctcccggtggcctgcggtgcctccctggggactccagatccatgtatctgaaaggcagccctccagacccccaccctgtcctcagcagccagggcaggccacttgtgagaccctctcctctgccccagaccccagcactacgagaatgtcccctccctgtccccagccccagtcggctccagggggcattgggtgctggagactaaaggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 953 - DNA, 384 bp, synthetic construct
  misc_feature 1..384: note = Synthetic polypeptide
  source 1..384: mol_type = other DNA
atgcccaggacttctacgactggctgcaggagacagacgtggatctctctggggtcaagttcgcgcttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 954 - DNA, 657 bp, synthetic construct
  misc_feature 1..657: note = Synthetic polypeptide
  source 1..657: mol_type = other DNA
atgggctcccggtggcctgcggtgcctccctggggactccagatccatgtatctgaaaggcagccctccagacccccaccctgtcctcagcagccagggcaggccacttgtgagaccctctcctctgccccagaccccagcactacgagaatgtcccctccctgtccccagccccagtcggctccagggggcattgggtgctggagactaaaggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 955 - DNA, 757 bp, synthetic construct
  misc_feature 1..757: note = Synthetic polypeptide
  source 1..757: mol_type = other DNA
atgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaaatgcggccaaggtgtacatgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 956 - DNA, 174 bp, synthetic construct
  misc_feature 1..174: note = Synthetic polypeptide
  source 1..174: mol_type = other DNA
atgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 957 - DNA, 84 bp, synthetic construct
  misc_feature 1..84: note = Synthetic polypeptide
  source 1..84: mol_type = other DNA
atgatgagtcatccgtgtgtgtctcttttgggccatattaattcagccagaactgaacacctgacccaagggcagcaagcaatc

SEQ ID NO: 958 - DNA, 355 bp, synthetic construct
  misc_feature 1..355: note = Synthetic polypeptide
  source 1..355: mol_type = other DNA
atggctcttacacaggatgtgggcaaactcacgactgcgcctgccgccagaaggtttgctgagggccgtcactccctggcgccgggctccttgaagttatctactgggaaatctagagcttattgttggaaggatgcagtcttgcaagcctgctgtgatccaaacggccgactgagttaccaacaatcacccccacttctggttatctcttttacctaataaatttggagggctgaaaaagctcagggcccttgtccactagaggcaagatgccccctggccccttcttccaaatatactctcttgtctttttcttttattcccgcgttcacccgctttgttcagtccaccaggg

SEQ ID NO: 959 - DNA, 1007 bp, synthetic construct
  misc_feature 1..1007: note = Synthetic polypeptide
  source 1..1007: mol_type = other DNA
atggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaataggcagaatctttggcggtatggggaaataattcgacggatcctggg

SEQ ID NO: 960 - DNA, 1481 bp, synthetic construct
  misc_feature 1..1481: note = Synthetic polypeptide
  source 1..1481: mol_type = other DNA
atgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaataggcagaatctttggcggtatggggaaataattcgacggatcctggg

SEQ ID NO: 961 - DNA, 460 bp, synthetic construct
  misc_feature 1..460: note = Synthetic polypeptide
  source 1..460: mol_type = other DNA
atggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggctcataggcagaagggacttgccttatcttggatgagactttggactgtggacttttgaattaatgctgaaaagagttaagactgttggaaaggcatgattggttttgaaatgtgaggacatgagatttgggagggaccaggggcagaa

SEQ ID NO: 962 - DNA, 2721 bp, synthetic construct
  misc_feature 1..2721: note = Synthetic polypeptide
  source 1..2721: mol_type = other DNA
atggcagcctccttacggctcctcggagctgcctccggtctccggtactggagccggcggctgcggccggcagccggcagctttgcagcggtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcagtgcaataccataaaccttgaatgacaccatgggacccatacaaagtgccactagtgatgctggaagtgctcctaagaagctgagaaaagtcatgacattacaagaaaaagttgaattgcctgatacataccatggattgaggtctgcggctgcgtttgccctccatttcaagataaacaaatccaatgtaaggaccattgtaaacaaagaaaagaatagtcatgaacccatcactgcagctactccagcaggcttgcactttttgcagaacatctttttatctcacattgaaaatgcagcttttatgtagatgcaggattgctgtagaaaggcatacttacatctaatatgattcaagaaaaatatgacaacttaaagcaaaaagaaagtgaaggatctaaagctggagaatttaatgccagcaaaggatggtttgataattttaggaagaggtttgcttaaaaaatgtcaagaaataggcgaagtagcttctgccaaccaagagacagcagacagttcccaggcgccattaagaaaaaatcattgaagagaaagtatatctgcctgaatgagtttttaatgcagacagaagtgccctattacggagaaaaaaaaaaaaaaaaggatgctcgaaggacatttattaggaagagaagcaagcagcaccaggatttaaggcaggaaaggataggctaactctactgttttgtacaaatgcagttgggttgaaaatcaggactgcccttatctataaagttgctaacttctgaggctttaagtgaaaagataaataccagctgcctgtcttttggttgtacagcaagaaggcctggacgatgagaaccctgtttctggattgtttccatcaatggctttgtctctggagtcaggcaatatcttgccagtaagggactgacttttaaagttattttgatattggacagtacccctggccacccagaataacatgagttcaacactgaaggtgtccaaggggccaacttgcccctaaacataacgcccctaattcagcctctagagtaggggatcataaggacctttaaggctcattacacatggtactctatgggaaggattgtcactgtggaagaaaaccctgatagaacatgaaaatctggaaagattacaccattgaagatgccattgttattgtggaaaacgccttgaaggccatcaagcccctaacagtaaattcctgctggaaaaaactgtccagatgttgtgcaagacttcacaggatttatggcagggccaatcaaggaaatcactaaagagattgtgcatatggcaaaaaaggtggggagtgtatgaaggctttcaagatatggatcttggattaattcaagagctaatagacaccacagcagagtaattaacagaagaggcttgatggagatgagtgcttctgaacagtaccagatgatgaggaagaagatgtaccaaaagcagtgccaggaaacaaattgacattagacagtatggcagaacggttctgattattcaagactcctttcaacttcttttacaacatggacccttctctgatacagacactgaaaataaagcaaacagtggaagacggattggtaccatacaaaaacgtttttagagaaatgaaagagcaaaaacatcagatagaaattacaatttccataaagttatccggagtgtgcctgccccttctgcctccccttctaccacctccacctcttctgcctctgtcaccccgagacagcgaagagcaacccctcctcttcctcctcagcctactcattattaagatgatgggattgaagacctttatgatgatccacttccacttaatgaataataaatatattttatcttccttaatgattcccttagtaacatttttttctctagcttgctttaccataagaatacaatatataatacatatacaaaatatgtgttaatcaactgtttatgttattgacgaggcttccagtcaacagtgggctattagtagttaagtttttggagagtcaaaagttatacatgggtttttgactgcactgggggttggcacccctaaccccctcatcattcaagggtcaactg

SEQ ID NO: 963 - DNA, 2549 bp, synthetic construct
  misc_feature 1..2549: note = Synthetic polypeptide
  source 1..2549: mol_type = other DNA
ctgaattacctcatactctgaagttaccaggcttacctctgtttcccaacaagtttcttatttctttagtgttgctaattttagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcagtgcaataccataaaccttgaatgacaccatgggacccatacaaagtgccactagtgatgctggaagtgctcctaagaagctgagaaaagtcatgacattacaagaaaaagttgaattgcctgatacataccatggattgaggtctgcggctgcgtttgccctccatttcaagataaacaaatccaatgtaaggaccattgtaaacaaagaaaagaatagtcatgaacccatcactgcagctactccagcaggcttgcactttttgcagaacatctttttatctcacattgaaaatgcagcttttatgtagatgcaggattgctgtagaaaggcatacttacatctaatatgattcaagaaaaatatgacaacttaaagcaaaaagaaagtgaaggatctaaagctggagaatttaatgccagcaaaggatggtttgataattttaggaagaggtttgcttaaaaaatgtcaagaaataggcgaagtagcttctgccaaccaagagacagcagacagttcccaggcgccattaagaaaaaatcattgaagagaaagtatatctgcctgaatgagtttttaatgcagacagaagtgccctattacggagaaaaaaaaaaaaaaaaggatgctcgaaggacatttattaggaagagaagcaagcagcaccaggatttaaggcaggaaaggataggctaactctactgttttgtacaaatgcagttgggttgaaaatcaggactgcccttatctataaagttgctaacttctgaggctttaagtgaaaagataaataccagctgcctgtcttttggttgtacagcaagaaggcctggacgatgagaaccctgtttctggattgtttccatcaatggctttgtctctggagtcaggcaatatcttgccagtaagggactgacttttaaagttattttgatattggacagtacccctggccacccagaataacatgagttcaacactgaaggtgtccaaggggccaacttgcccctaaacataacgcccctaattcagcctctagagtaggggatcataaggacctttaaggctcattacacatggtactctatgggaaggattgtcactgtggaagaaaaccctgatagaacatgaaaatctggaaagattacaccattgaagatgccattgttattgtggaaaacgccttgaaggccatcaagcccctaacagtaaattcctgctggaaaaaactgtccagatgttgtgcaagacttcacaggatttatggcagggccaatcaaggaaatcactaaagagattgtgcatatggcaaaaaaggtggggagtgtatgaaggctttcaagatatggatcttggattaattcaagagctaatagacaccacagcagagtaattaacagaagaggcttgatggagatgagtgcttctgaacagtaccagatgatgaggaagaagatgtaccaaaagcagtgccaggaaacaaattgacattagacagtatggcagaacggttctgattattcaagactcctttcaacttcttttacaacatggacccttctctgatacagacactgaaaataaagcaaacagtggaagacggattggtaccatacaaaaacgtttttagagaaatgaaagagcaaaaacatcagatagaaattacaatttccataaagttatccggagtgtgcctgccccttctgcctccccttctaccacctccacctcttctgcctctgtcaccccgagacagcgaagagcaacccctcctcttcctcctcagcctactcattattaagatgatgggattgaagacctttatgatgatccacttccacttaatgaataataaatatattttatcttccttaatgattcccttagtaacatttttttctctagcttgctttaccataagaatacaatatataatacatatacaaaatatgtgttaatcaactgtttatgttattgacgaggcttccagtcaacagtgggctattagtagttaagtttttggagagtcaaaagttatacatgggtttttgactgcactgggggttggcacccctaaccccctcatcattcaagggtcaactg

SEQ ID NO: 964 - DNA, 1689 bp, synthetic construct
  misc_feature 1..1689: note = Synthetic polypeptide
  source 1..1689: mol_type = other DNA
atggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcggggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccctaatgtgtccagcagccatgagaatctggagcctgagacagaaaccgagtcagtagtgtcactgaggcgggagcggcctcgcaggagagacagcagtgagcatggcgctgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaaatgagcccatccagccaattgaccctgctgcctgggtgtcccattccgcggctctgactggcaccttcccagcctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctgtcctgcactggccgaggatgggggctgacgtccacccatgtgctgctggacaagccatgtgccaggtgcaggactgtgtccaccgggggaaggtgcacctcttacctgagtcccgcaaagacgtgggctagtggctgtgcccctg

SEQ ID NO: 965 - DNA, 1671 bp, synthetic construct
  misc_feature 1..1671: note = Synthetic polypeptide
  source 1..1671: mol_type = other DNA
atggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcggggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccatgagaatctggagcctgagacagaaaccgagtcagtagtgtcactgaggcgggagcggcctcgcaggagagacagcagtgagcatggcgctgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaaatgagcccatccagccaattgaccctgctgcctgggtgtcccattccgcggctctgactggcaccttcccagcctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctgtcctgcactggccgaggatgggggctgacgtccacccatgtgctgctggacaagccatgtgccaggtgcaggactgtgtccaccgggggaaggtgcacctcttacctgagtcccgcaaagacgtgggctagtggctgtgcccctg

SEQ ID NO: 966 - DNA, 650 bp, synthetic construct
  misc_feature 1..650: note = Synthetic polypeptide
  source 1..650: mol_type = other DNA
tgaactttgagaacatgagcaacgatgacgctgtgcgggtgctgagggacattgtgcacaagcctggccccattgtgctgactgtggccaagtgctgggatccctctcctcaggcctatttcactctcccccgaacctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctgtcctgcactggccgaggatgggggctgacgtccacccatgtgctgctggacaagccatgtgccaggtgcaggactgtgtccaccgggggaaggtgcacctcttacctgagtcccgcaaagacgtgggctagtggctgtgcccctg

SEQ ID NO: 967 - DNA, 645 bp, synthetic construct; identical to SEQ ID NO: 137
  misc_feature 1..645: note = Synthetic polypeptide
  source 1..645: mol_type = other DNA

SEQ ID NO: 968 - DNA, 384 bp, synthetic construct
  misc_feature 1..384: note = Synthetic polypeptide
  source 1..384: mol_type = other DNA
atggctgcctttccccacaagattatatttttcctggtatgctctactttgacacatgtggctttctcaggtggaacaatataatcacaaggattcttatcagagggaggcaggagggcccaagtcagagaagatgtgacaatggaagcagaagttagaatggtgcagtaaaagggccatgggccgaggaactcagacagcctgtagaagctggaaaaggtaaggaaattaattcttccttagaaactccaggaggaatgcatcactgctgacatcttgactttaggacttctcacctccagaattgtaagataataaatttgtgttttgttaagtcactaagtttgtgacaattcattacaacagcaataagaaaatagtaca

SEQ ID NO: 969 - DNA, 1041 bp, synthetic construct
  misc_feature 1..1041: note = Synthetic polypeptide
  source 1..1041: mol_type = other DNA
atggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctgatgtgatggctggaattccagtcaccattttggaccatgaggacaacaccctagagatgtggagtggctaaaagaagcctgtgttcctgagaacttagaggaccaggacctctattccaggcttggacacctacatttagactattatatgaggaagcaatcaacttctcacttgtttcaaccactttcacttgcagtcaaacctgaattgtaagtga

SEQ ID NO: 970 - DNA, 877 bp, synthetic construct
  misc_feature 1..877: note = Synthetic polypeptide
  source 1..877: mol_type = other DNA
atgtcggacgatttcttatggtttgaaggcatagctttccctactatgggtttcagatccgaaaccttaagaaaagtacgtgatgagtttgtgataagggatgaagatgtaataatattgacttaccccaaatcaggaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaacttcctgttactgagttatgaggagctgaaacaggtgcggtggttcacatccataatcccagcactttgggaggctgaggtgggcagatcacctgagctcaggagttggaacccagcttggccaacatggtgatactccctctctactaaaaatacgtaaattagccgggagtggtggcgcacgcctgtaaccccagctactcgggaggttgagacaggagaattgcttgagcctgggaggcggaggttgcagtgagctgagatcatgccactgcactccagcctgggcgacagagtgagatcttgtctctaaataaatacataaataaaattttaaaaataaa

SEQ ID NO: 971 - DNA, 213 bp, synthetic construct
  misc_feature 1..213: note = Synthetic polypeptide
  source 1..213: mol_type = other DNA
atggtatcacatcggtatcctcgaattcaaagtatcaaagtacaatttaccggttcgttggcaaaagggacttgccttgtctcagacgagactatggattttgacctttggatgaatgctgaaatgagttaagactttggggaactgttgggaaggcataattgtgttttgaaatgtgagaaacaggagatttgggagggaccaggggtagaa

SEQ ID NO: 972 - DNA, 363 bp, synthetic construct
  misc_feature 1..363: note = Synthetic polypeptide
  source 1..363: mol_type = other DNA
atggaaagggtccaacccctggaagagaatgtgggaaatgcagccaggccaagattcgagaggaacaagctattgctggtggcctctgtaattcagggactggggctgctcctgtgcttcacctacatctgcctgcacttctctgctcttcaggtatcacatcggtatcctcgaattcaaagtatcaaagtacaatttaccggttcgttggcaaaagggacttgccttgtctcagacgagactatggattttgacctttggatgaatgctgaaatgagttaagactttggggaactgttgggaaggcataattgtgttttgaaatgtgagaaacaggagatttgggagggaccaggggtagaa

SEQ ID NO: 973 - DNA, 822 bp, synthetic construct; identical to SEQ ID NO: 119
  misc_feature 1..822: note = Synthetic polypeptide
  source 1..822: mol_type = other DNA

SEQ ID NO: 974 - DNA, 806 bp, synthetic construct
  misc_feature 1..806: note = Synthetic polypeptide
  source 1..806: mol_type = other DNA
atggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagacactcttgcttgctcctgcttccagcatgtcatgtgcctgctcccccttcaccttctgcccatgcttataagcttcctgagacctctctagaagccaagcggatgccagcaccatgcttcctgtaaagcctgcagaacgatgagccaattaaaactcttttcttgataaattactcagtctcagttatttctttataacaacgcaaaaatggcctaatac

SEQ ID NO: 975 - DNA, 193 bp, synthetic construct
  misc_feature 1..193: note = Synthetic polypeptide
  source 1..193: mol_type = other DNA
atggcctggtggaaagcctgggagaatgaataaacagactaggttgaatccatacaatggaatggtagcagacaataaaaagaaaatgaactattgatgccccctactgcacagcagaagctctgaatcgtgttcctgaatgaaagaagtcaggtatgaaagaataaacattgtatgattccatttatatgaa

SEQ ID NO: 976 - DNA, 1398 bp, synthetic construct; identical to SEQ ID NO: 948
  misc_feature 1..1398: note = Synthetic polypeptide
  source 1..1398: mol_type = other DNA

SEQ ID NO: 977 - DNA, 1302 bp, synthetic construct; identical to SEQ ID NO: 949
  misc_feature 1..1302: note = Synthetic polypeptide
  source 1..1302: mol_type = other DNA

SEQ ID NO: 978 - DNA, 3992 bp, synthetic construct; identical to SEQ ID NO: 120
  misc_feature 1..3992: note = Synthetic polypeptide
  source 1..3992: mol_type = other DNA

SEQ ID NO: 979 - DNA, 3845 bp, synthetic construct; identical to SEQ ID NO: 121
  misc_feature 1..3845: note = Synthetic polypeptide
  source 1..3845: mol_type = other DNA

SEQ ID NO: 980 - DNA, 1236 bp, synthetic construct
  misc_feature 1..1236: note = Synthetic polypeptide
  source 1..1236: mol_type = other DNA
atgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagaacatctcaccagactagggatctgccaaactttgggaaattctg

SEQ ID NO: 981 - DNA, 749 bp, synthetic construct
  misc_feature 1..749: note = Synthetic polypeptide
  source 1..749: mol_type = other DNA
atgcctccgctctgggccctgctggccctcggctgcctgcggttcggctcggctgtgaacctgcagccccaactggccagtgtgactttcgccaccaacaaccccacacttaccactgtggccttggaaaagcctctctgcatgtttgacagcaaagaggccctcactggcacccacgaggtctacctgtatgtcctggtcgactcagccatttccaggaatgcctcagtgcaagacagcaccaacaccccactgggctcaacgttcctacaaacagagggtgggaggacaggtccctacaaagctgtggcctttgacctgatcccctgcagtgacctgcccagcctggatgccattggggatgtgtccaaggcctcacagatcctgaatgcctacctggtcagggtgggtgccaacgggacctgcctgtgggatcccaacttccagggcctctgtaacgcacccctgtcggcagccacggagtacaggttcaagtatgtcctggtcaatatgtccacgggcttggtagaggaccagaccctgtggtcagaccccatccgcaccaaccagctcaccccatactcgacgatcgacacgtggccaggccggcggagcggaggcatgatcgtcatcacttccatcctgggctccctgcccttctttctacttgtgggttttgctggcgccattgccctcagcctcgtggcctggcacagggtcagtgctccagaaagatggattgattgaat

SEQ ID NO: 982 - DNA, 386 bp, synthetic construct
  misc_feature 1..386: note = Synthetic polypeptide
  source 1..386: mol_type = other DNA
atgcctccgctctgggccctgctggccctcggctgcctgcggttcggctcggctgtgaacctgcagccccaactggccagtgtgactttcgccaccaacaaccccacacttaccactgtggccttggaaaagcctctctgcatgtttgacagcaaagaggccctcactggcacccacgaggtctacctgtatgtcctggtcgactcagtcaccccatactcgacgatcgacacgtggccaggccggcggagcggaggcatgatcgtcatcacttccatcctgggctccctgcccttctttctacttgtgggttttgctggcgccattgccctcagcctcgtggcctggcacagggtcagtgctccagaaagatggattgattgaat

SEQ ID NO: 983 - DNA, 999 bp, synthetic construct
  misc_feature 1..999: note = Synthetic polypeptide
  source 1..999: mol_type = other DNA
atgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacagggttccacagagctgagccccttgggtctaccctttgtactcttctcaccaactagattgttggagatttctcgacctatgccttcaggtactacatgataacagcttatttccaaagccatatctgtagtcgttcctctcttgtgagcttggaccctgtatccttttgcctactggcaaagccccaggtgtatctaaaattcagcttatctaaagcatgattcactgtccttcctttcaaaacctaattcttgttctgtacagcctattttcatgaaaagcactacctagactctgtctggttggcaggccagaaacttcagag

SEQ ID NO: 984 - DNA, 4805 bp, synthetic construct
  misc_feature 1..4805: note = Synthetic polypeptide
  source 1..4805: mol_type = other DNA
atggagcggcggctgcgcgcgctggagcagctggcgcggggcgaggccggcggctgcccggggctcgacggcctcctagatctgctgctggcgctgcaccacgagctcagcagcggccccctacggcgggagcgcagcgtggcgcagttcctgagctgggccagccccttcgtatcaaaggtgaaagaactgcgtctgcagagagatgactttgagatcttgaaggtgatcggccgaggagcctttggggaggtcaccgtggtgaggcagagggacactgggcagatttttgccatgaaaatgctgcacaagtgggagatgctgaagagggctgagacagcctgtttccgggaggagcgggatgtgctcgtgaaaggggacagccgttgggtgaccactctgcactatgccttccaagacgaggagtacctgtaccttgtgatggactactatgctggtggggacctcctgacgctgctgagccgcttcgaggaccgtctcccgcccgagctggcccagttctacctggctgagatggtgctggccatccactcgctgcaccagctgggttatgtccacagggatgtcaagccagacaacgtcctgctggatgtgaacgggcacattcgcctggctgacttcggctcctgcctgcgtctcaacaccaacggcatggtggattcatcagtggcagtagggacgccggactatatctcccctgagatcctgcaggccatggaggagggcaagggccactacggcccacagtgtgactggtggtcgcttggagtctgcgcctatgagctgctctttggggagacgcccttctatgctgagtccttggtggaaacctacggcaagatcatgaaccacgaggaccacctgcagttccccccggacgtgcctgacgtgccagccagcgcccaagacctgatccgccagctgctgtgtcgccaggaagagcggctaggccgtggtgggctggatgacttccggaaccatcctttcttcgaaggcgtggactgggagcggctggcgagcagcacggccccctatattcctgagctgcgggggcccatggacacctccaactttgatgtggatgacgacaccctcaaccatccagggaccctgccaccgccctcccacggggccttctccggccatcacctgccattcgtgggcttcacctacacctcaggcagtcacagtcctgagagcagctctgaggcttgggctgccctggagcggaagctccagtgtctggagcaggagaaggtggagctgagcaggaagcaccaagaggccctgcacgcccccacagaccatcgggagctggagcagctacggaaggaagtgcagactctgcgggacaggctgccagagatgctgagggacaaggcctcattgtcccagacggatgggcccccagctggtagcccaggtcaggacagtgacctacggcaggagcttgaccgacttcaccgggagctggccgagggtcgggcagggctgcaggctcaggagcaggagctctgcagggcccaggggcagcaggaggagctgcttcagaggctacaggaggcccaggagagagaggcggccacagctagccagacccgggccctgagctcccagctggaggaagcccgggctgcccagagggagctggaggcccaggtgtcctccctgagccggcaggtgacgcagctgcagggacagtgggagcaacgccttgaggagtcgtcccaggccaagaccatccacacagcctctgagaccaacgggatgggaccccctgagggtgggcctcaggaggcccaactgaggaaggaggtggccgccctgcgagagcagctggagcaggcccacagccacaggccgagtggtaaggaggaggctctgtgccagctgcaggaggaaaaccggaggctgagccgggagcaggagcggctagaagcagagctggcccaggagcaggagagcaagcagcggctggagggtgagcggcgggagacggagagcaactgggaggcccagctcgccgacatcctcagctgggtgaatgatgagaaggtctcaagaggctacctgcaggccctggccaccaagatggcagaggagctggagtccttgaggaacgtaggcacccagacgctccctgcccggccactggaccaccagtggaaggcgcggcgactgcagaagatggaggcctcggccaggctggagctgcagtcagcgctggaggccgagatccgcgccaagcagggcctgcaggagcggctgacacaggtgcaggaggcccagctgcaggctgagcgccgtctgcaggaggccgagaagcagagccaggccctgcaacaggagctcgccatgctgcgggaggagctgcgggcccgagggccagtggacaccaagccctcaaactccctgattcccttcctgtccttccggagctcagagaaggattctgccaaggaccctggcatctcaggagaggccacaaggcatggaggagagccagatctgaggccggagggccgacgcagcctgcgcatgggggctgtgttccccagagcacccactgccaacacagcctctacagaaggtcttcctgctaagcccggctcacacacgctgcgcccccggagcttcccatccccgaccaagtgtctccgctgcacctcgctgatgctgggcctgggccgccagggcctgggttgtgatgcctgcggctacttttgtcacacaacctgtgccccacaggccccaccctgccccgtgccccctgacctcctccgcacagccctgggagtacaccccgaaacaggcacaggcactgcctatgagggctttctgtcggtgccgcggccctcaggtgtccggcggggctggcagcgcgtgtttgctgccctgagtgactcacgcctgctgctgtttgacgcccctgacctgaggctcagcccgcccagtggggccctcctgcaggtcctagatctgagggacccccagttctcggctacccctgtcctggcctctgatgttatccatgcccaatccagggacctgccacgcatctttagggtgacaacctcccagctggcagtgccgcccaccacgtgcactgtgctgctgctggcagagagcgagggggagcgggaacgctggctgcaggtgctgggtgagctgcagcggctgctgctggacgcgcggccaagaccccggcccgtgtacacactcaaggaggcttacgacaacgggctgccgctgctgcctcacacgctctgcgctgccatcctcgaccaggatcgacttgcgcttggcaccgaggaggggctctttgtcatccatctgcgcagcaacgacatcttccaggtgggggagtgccggcgcgtgcagcagctgaccttgagccccagtgcaggcctgctggtcgtgctgtgtggccgcggccccagcgtgcgtctctttgccctggcggagctggagaacatagaggtagcaggtgccaagatccccgagtctcgaggctgccaggtgctggcagctggaagcatcctgcaggcccgcaccccggtgctctgtgtagccgtcaagcgccaggtgctctgctaccagctgggcccgggccctgggccctggcagcgccgcatccgtgagctgcaggcacctgccactgtgcagagcctggggctgctgggcgaccggctatgtgtgggcgccgccggtggctttgcactctacccgctgctcaacgaggctgcgccgttggcgctgggggccggtttggtgcctgaggagctgccaccatcccgcgggggcctgggtgaggcactgggtgccgtggagcttagcctcagcgagttcctgctactcttcaccactgctggcatctacgtggatggcgcaggccgcaagtctcgtggccacgagctgttgtggccagcagcgcccatgggctgggggtatgcggccccctacctgacagtgttcagcgagaactccatcgatgtgtttgacgtgaggagggcagaatgggtgcagaccgtgccgctcaagaaggtgcggcccctcaatccagagggctccctgttcctctacggcaccgagaaggtccgcctgacctacctcaggaaccagctggcagagaaggacgagttcgacatcccggacctcaccgacaacagccggcgccagctgttccgcaccaagagcaagcgccgcttctttttccgcgtgtcggaggagcagcagaagcagcagcgcagggagatgctgaaggacccttttgtgcgctccaagctcatctcgccgcctaccaacttcaaccacctagtacacgtgggccctgccaacgggcggcccggcgccagggacaagtccccggctcccgaagagaagggccgagttgcccgcggctccggcccacagcggccccacagcttctccgaggcgttgcggcgcccagcctccatgggcagcgaaggcctcggtggagacgcagaccccatgaagaggaaaccctggacatccctgtccagcgagtctgtgtcctgcccccagggatcgctgagccctgcaacctccctaatgcaggtgacccaccaggatcatcttcaaaggagccttcctggccgcttggtcaggtagtcattgcctccctggggctggtgccacctttgccaccccgctccctccacaccttccttgcagcttctgctgtgctgtgggtttcttctggtgcctgttctcctctgttgactgtgggctccttggtggtgggggtcaggcttcattcttct

SEQ ID NO: 985 - DNA, 1379 bp, synthetic construct
  misc_feature 1..1379: note = Synthetic polypeptide
  source 1..1379: mol_type = other DNA
atgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaaggtgatgacagagggtggccacagcaaggggtttggctttgtgtgtttttcctccccagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccagcctccagcccaggctgcatactatggctgtggcccagtgacacccacccagcctgcccccaggtggacatcccagccacctagaccttcctgtgggtgacttcacttctctgagcctcagtttcctcttctgagcatggg

SEQ ID NO: 986 - DNA, 1081 bp, synthetic construct
  misc_feature 1..1081: note = Synthetic polypeptide
  source 1..1081: mol_type = other DNA
atgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaagaagcttggaagcggagtcttgcaacagtgcatcccgacagcagcaacctgatccccaagctttttcgacctgcagcgttcctgcctttcatggcacccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacaggtgacatgacatgagaattgccttaaaatactcaaggaaaaaaatcctactgctgggtgtgggaggtgcttgatgaaatgagatctgcaaattgttaatagtgattcctgagtgagcacatgtgagttcattacattccttctac

SEQ ID NO: 987 - DNA, 1054 bp, synthetic construct
  misc_feature 1..1054: note = Synthetic polypeptide
  source 1..1054: mol_type = other DNA
atgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaagggcaacagtgcatcccgacagcagcaacctgatccccaagctttttcgacctgcagcgttcctgcctttcatggcacccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacaggtgacatgacatgagaattgccttaaaatactcaaggaaaaaaatcctactgctgggtgtgggaggtgcttgatgaaatgagatctgcaaattgttaatagtgattcctgagtgagcacatgtgagttcattacattccttctac

SEQ ID NO: 988 - DNA, 1146 bp, synthetic construct
  misc_feature 1..1146: note = Synthetic polypeptide
  source 1..1146: mol_type = other DNA
atgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaa

SEQ ID NO: 989 - DNA, 1731 bp, synthetic construct
  misc_feature 1..1731: note = Synthetic polypeptide
  source 1..1731: mol_type = other DNA
atgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccagcttggccgcggaggaagctgggttggaggactcgcccgactccgggtggagactatgtctgcgtcttcacggacctctgcaccctgaggggctgtccccagacggtcacgaactgcctttcctctttgagcagcctgactctgcctctctgtctgcaggagcctggtcgggctatggccatgtggccgcctgccagctaatgggcccccacaccctggccttgagggtgggagagagccagctcctcctgcagagcccccaggcggaggttgcagtgagccgaggcacttcagcctggcaacagagcaagactccgtct

SEQ ID NO: 990 - DNA, 2262 bp, synthetic construct
  misc_feature 1..2262: note = Synthetic polypeptide
  source 1..2262: mol_type = other DNA
atgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccaggtttgagaacttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcagcgggacttctctccgcgggtgcccctgccccgcctggaccgcctgctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggcggaggttgcagtgagccgaggcacttcagcctggcaacagagcaagactccgtct

SEQ ID NO: 991 - DNA, 2253 bp, synthetic construct
  misc_feature 1..2253: note = Synthetic polypeptide
  source 1..2253: mol_type = other DNA
atgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccagcttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcagcgggacttctctccgcgggtgcccctgccccgcctggaccgcctgctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggcggaggttgcagtgagccgaggcacttcagcctggcaacagagcaagactccgtct

SEQ ID NO: 992 - DNA, 434 bp, synthetic construct
  misc_feature 1..434: note = Synthetic polypeptide
  source 1..434: mol_type = other DNA
atgcgcacggcggacggaggcgagccggccggggcttcctccccggccggcagggtggacggtgggctcggtctttgcatgcaccaccacatctggctaatcaagtgaagatgaggccaaactggatgaaggcgggcctgaaatccaacgactggtgaccttataaggagggagagcttcaaagacccaggcagtcatagagggaagaagggcaagtggcaaagaagacagagattgggtttctgttgccaccgaggctgccagaagaggcaaggaagaatcctcccctagagccttcagaggcagatgcctggccctgctgacggtttggttttgaacttttagcctccagaactgtgcaagaataaatttctgttgttttaagccatcgggtttgtggtaatttgttatggcagctctaggaaactaatcca

SEQ ID NO: 993 - DNA, 1221 bp, synthetic construct; identical to SEQ ID NO: 122
  misc_feature 1..1221: note = Synthetic polypeptide
  source 1..1221: mol_type = other DNA

SEQ ID NO: 994 - DNA, 413 bp, synthetic construct
  misc_feature 1..413: note = Synthetic polypeptide
  source 1..413: mol_type = other DNA
atgctcctgtctgggggcgatcctccggcgcaggaatggttcatggtgcagacaaaatcgaagcctcgggtgcagcggcagcggctgcaagtgcagcgcatctttagggtcaagctgaacgccttccagagccgcccggacaccccctacttctggctacagctcgaggggccccgagagaacatgggcaaagccaagtatagacggcatcatggtgaagacccccgactgtggagctagagtgcctgagtatcccagcctactaactgtgtgatcttggacatatggccttccttgctcatctaaaatggggataatagtatttccttaaagggcagagagaggaataaataagataatgtgtgcaaagtgcctgacacataataagctctcactaaatattagttcatatt

SEQ ID NO: 995 - DNA, 317 bp, synthetic construct
  misc_feature 1..317: note = Synthetic polypeptide
  source 1..317: mol_type = other DNA
atgactcgcgatttcaaacctggagacctcatcttcgccaagatgaaaggttatccccattggccagctcgagtagacgaagttcctgatggagctgtaaagccacccacaaacaaactacccattttcttttttggaactcatgagacgctcctaggtggaagagacttgccttgcctcagatgagactttggacttggacttttgagttaatgctggaatgagttaagactttgggggatggggactgttggaagggcatggttgtgttttgaaatgtgaggacatgagatttgagagagggggcaggggcagaa

SEQ ID NO: 996 - DNA, 1052 bp, synthetic construct; identical to SEQ ID NO: 247
  misc_feature 1..1052: note = Synthetic polypeptide
  source 1..1052: mol_type = other DNA

SEQ ID NO: 997 - DNA, 327 bp, synthetic construct; identical to SEQ ID NO: 246
  misc_feature 1..327: note = Synthetic polypeptide
  source 1..327: mol_type = other DNA

SEQ ID NO: 998 - DNA, 314 bp, synthetic construct
  misc_feature 1..314: note = Synthetic polypeptide
  source 1..314: mol_type = other DNA
atgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggtcttaattctgaaaggagagcacttctaccacatgacatgatggtttcatcgatctaaaagataagaccatcacctggccttttgaggaatcctcatgtcactgaagcaacagccaagg

SEQ ID NO: 999 - DNA, 2141 bp, synthetic construct
  misc_feature 1..2141: note = Synthetic polypeptide
  source 1..2141: mol_type = other DNA
atgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatcgaaaaaccaggccatacagagataggagctgaggggacatagtgagaagtgaccagaagacaagagtgcgagccttctgttatgcccagacagggccaccaaagggctccttggtctagtggtaacgccagcgtctgggaagacgcccgttgccaggcggaccgaggtctagcagtagcgtaagtgtcaaaggaaaacacccactatttagcagaccgggaaagggagtctgcttttcccctggggagtttagagaagactgctcctccacctcttgtggagggcctgacatcagtcaggcttgcctgcaattatccagaggcctaaccgtctccctatggtgctgtgcttcagtggtcacgctcctagtctgccttcatgttccatcctgtacacctggctctgccttctagatagcagtagtaaattagtgaaagtactaaaagtctctaatatgcagaaacaatggcgtaagctgtctttctctctgtctcctctccctctctgcctcggctgccaggcggggaagggccccctctccagtggacacgtaacccacgtgaccttacctatcattggagatgactcacactctttaccctgccccttgtgttttgtttccaataaataacagtgcagccagacattcagggccactactggtctccgcgtcttggtggtagtggtcccccgtgcccagctgtcttttttttttaaatctctgtgtctcgtgtctttatttctgcactctctcgtcgctgcatacagggagaagcccaccgaccctgtggggctggtcgctaca

SEQ ID NO: 1000 - DNA, 2006 bp, synthetic construct
  misc_feature 1..2006: note = Synthetic polypeptide
  source 1..2006: mol_type = other DNA
atgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatcgaaaaaccaggccatacagagataggagctgaggggacatagtgagaagtgaccagaagacaagagtgcgagccttctgttatgcccagacagggccaccaaagggctccttggtctagtggtaacgccagcgtctgggaagacgcccgttgccaggcggaccgaggtctagcagtagcgtaagtgtcaaaggaaaacacccactatttagcagaccgggaaagggagtctgcttttcccctggggagtttagagaagactgctcctccacctcttgtggagggcctgacatcagtcaggcttgcctgcaattatccagaggcctaaccgtctccctatggtgctgtgcttcagtggtcacgctcctagtctgccttcatgttccatcctgtacacctggctctgccttctagatagcagtagtaaattagtgaaagtactaaaagtctctaatatgcagaaacaatggcgtaagctgtctttctctctgtctcctctccctctctgcctcggctgccaggcggggaagggccccctctccagtggacacgtaacccacgtgaccttacctatcattggagatgactcacactctttaccctgccccttgtgttttgtttccaataaataacagtgcagccagacattcagggccactactggtctccgcgtcttggtggtagtggtcccccgtgcccagctgtcttttttttttaaatctctgtgtctcgtgtctttatttctgcactctctcgtcgctgcatacagggagaagcccaccgaccctgtggggctggtcgctaca

SEQ ID NO: 1001 - DNA, 2045 bp, synthetic construct
  misc_feature 1..2045: note = Synthetic polypeptide
  source 1..2045: mol_type = other DNA
atgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatcgaaaaaccaggccatacagagataggagctgaggggacatagtgagaagtgaccagaagacaagagtgcgagccttctgttatgcccagacagggccaccaaagggctccttggtctagtggtaacgccagcgtctgggaagacgcccgttgccaggcggaccgaggtctagcagtagcgtaagtgtcaaaggaaaacacccactatttagcagaccgggaaagggagtctgcttttcccctggggagtttagagaagactgctcctccacctcttgtggagggcctgacatcagtcaggcttgcctgcaattatccagaggcctaaccgtctccctatggtgctgtgcttcagtggtcacgctcctagtctgccttcatgttccatcctgtacacctggctctgccttctagatagcagtagtaaattagtgaaagtactaaaagtctctaatatgcagaaacaatggcgtaagctgtctttctctctgtctcctctccctctctgcctcggctgccaggcggggaagggccccctctccagtggacacgtaacccacgtgaccttacctatcattggagatgactcacactctttaccctgccccttgtgttttgtttccaataaataacagtgcagccagacattcagggccactactggtctccgcgtcttggtggtagtggtcccccgtgcccagctgtcttttttttttaaatctctgtgtctcgtgtctttatttctgcactctctcgtcgctgcatacagggagaagcccaccgaccctgtggggctggtcgctaca

SEQ ID NO: 1002 - DNA, 1212 bp, synthetic construct
  misc_feature 1..1212: note = Synthetic polypeptide
  source 1..1212: mol_type = other DNA
ccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatcgaaaaaccaggccatacagagataggagctgaggggacatagtgagaagtgaccagaagacaagagtgcgagccttctgttatgcccagacagggccaccaaagggctccttggtctagtggtaacgccagcgtctgggaagacgcccgttgccaggcggaccgaggtctagcagtagcgtaagtgtcaaaggaaaacacccactatttagcagaccgggaaagggagtctgcttttcccctggggagtttagagaagactgctcctccacctcttgtggagggcctgacatcagtcaggcttgcctgcaattatccagaggcctaaccgtctccctatggtgctgtgcttcagtggtcacgctcctagtctgccttcatgttccatcctgtacacctggctctgccttctagatagcagtagtaaattagtgaaagtactaaaagtctctaatatgcagaaacaatggcgtaagctgtctttctctctgtctcctctccctctctgcctcggctgccaggcggggaagggccccctctccagtggacacgtaacccacgtgaccttacctatcattggagatgactcacactctttaccctgccccttgtgttttgtttccaataaataacagtgcagccagacattcagggccactactggtctccgcgtcttggtggtagtggtcccccgtgcccagctgtcttttttttttaaatctctgtgtctcgtgtctttatttctgcactctctcgtcgctgcatacagggagaagcccaccgaccctgtggggctggtcgctaca

SEQ ID NO: 1003 - DNA, 1099 bp, synthetic construct
  misc_feature 1..1099: note = Synthetic polypeptide
  source 1..1099: mol_type = other DNA
tcaatggaaaacaaatttatgttggtcgagctcagaaaaaggtggaacggcagacggaacttaagcgcaaatttgaacagatgaaacaagataggatcaccagataccagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatcgaaaaaccaggccatacagagataggagctgaggggacatagtgagaagtgaccagaagacaagagtgcgagccttctgttatgcccagacagggccaccaaagggctccttggtctagtggtaacgccagcgtctgggaagacgcccgttgccaggcggaccgaggtctagcagtagcgtaagtgtcaaaggaaaacacccactatttagcagaccgggaaagggagtctgcttttcccctggggagtttagagaagactgctcctccacctcttgtggagggcctgacatcagtcaggcttgcctgcaattatccagaggcctaaccgtctccctatggtgctgtgcttcagtggtcacgctcctagtctgccttcatgttccatcctgtacacctggctctgccttctagatagcagtagtaaattagtgaaagtactaaaagtctctaatatgcagaaacaatggcgtaagctgtctttctctctgtctcctctccctctctgcctcggctgccaggcggggaagggccccctctccagtggacacgtaacccacgtgaccttacctatcattggagatgactcacactctttaccctgccccttgtgttttgtttccaataaataacagtgcagccagacattcagggccactactggtctccgcgtcttggtggtagtggtcccccgtgcccagctgtcttttttttttaaatctctgtgtctcgtgtctttatttctgcactctctcgtcgctgcatacagggagaagcccaccgaccctgtggggctggtcgctaca

SEQ ID NO: 1004 - DNA, 1420 bp, synthetic construct; identical to SEQ ID NO: 924
  misc_feature 1..1420: note = Synthetic polypeptide
  source 1..1420: mol_type = other DNA

SEQ ID NO: 1005 - DNA, 1336 bp, synthetic construct; identical to SEQ ID NO: 925
  misc_feature 1..1336: note = Synthetic polypeptide
  source 1..1336: mol_type = other DNA

SEQ ID NO: 1006 - DNA, 1069 bp, synthetic construct; identical to SEQ ID NO: 926
  misc_feature 1..1069: note = Synthetic polypeptide
  source 1..1069: mol_type = other DNA

SEQ ID NO: 1007 - DNA, 1345 bp, synthetic construct; identical to SEQ ID NO: 927
  misc_feature 1..1345: note = Synthetic polypeptide
  source 1..1345: mol_type = other DNA

SEQ ID NO: 1008 - DNA, 371 bp, synthetic construct
  misc_feature 1..371: note = Synthetic polypeptide
  source 1..371: mol_type = other DNA
atgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagagatgatgcagcaagaaggccttctccaggtgttaccccctccagcttagacttcctggcctccagaatggtgagccaataaatatctgttttgttttgaataccagtctgtggtattctgttgtagcaatacaaaatggaccaagaca

SEQ ID NO: 1009 - DNA, 272 bp, synthetic construct
  misc_feature 1..272: note = Synthetic polypeptide
  source 1..272: mol_type = other DNA
atgaaggaacttctgcacaaggagctgcccagctttgtgggggagaaagtggatgaggaggggctgaagaagctgatgggcagcctggatgagaacagtgaccagcaggtggacttccaggagagatgatgcagcaagaaggccttctccaggtgttaccccctccagcttagacttcctggcctccagaatggtgagccaataaatatctgttttgttttgaataccagtctgtggtattctgttgtagcaatacaaaatggaccaagaca

SEQ ID NO: 1010 - DNA, 143 bp, synthetic construct
  misc_feature 1..143: note = Synthetic polypeptide
  source 1..143: mol_type = other DNA
atgcagaaggtgaccctgggcctgcttgtgttcctggcaggctttcctgtcctggacgccaatgacctagaagataaaaacagtcctttctactatgcaccctgtgcatcctaggtgctccatatatatttgtcaagagaatg

SEQ ID NO: 1011 - DNA, 314 bp, synthetic construct
  misc_feature 1..314: note = Synthetic polypeptide
  source 1..314: mol_type = other DNA
atgggaagggggtatagtggggccttgcaggccagaggtggcttggaggagcccctggaaagaggcttaagaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatgcaccctgtgcatcctaggtgctccatatatatttgtcaagagaatg

SEQ ID NO: 1012 - DNA, 603 bp, synthetic construct
  misc_feature 1..603: note = Synthetic polypeptide
  source 1..603: mol_type = other DNA
atggctctacccaaagacgccatcccctcgctgtccgagtgccagtgcgggatctgcatggaaatcctcgtggagcccgtcaccctcccgtgtaaccacacgctgtgtaaaccgtgcttccagtcgaccgtcgaaaaggcgagtttatgctgtcccttctgtcgccgccgggtatcgtcgtggactcggtaccatacccgaagaaattctctcgtcaacgtggaactgtggacgataattcaaaaacactatcccagggagtgcaagcttagagcgtctggccaagaatcagaggaagtgggagaaatttggacacagagacagacacgcacagaaggaagatgatgtaaagacacagagtaccacgtgaggctggaggactggagtgatgtatttacaacccaaggaacgtctaaggttatcagcatactgtcagaagcaaggaagaggcaaggaaggatcccctacaagtttgaaaagtgtcatggccctgctgacacatttattttggacttttagccagaactgtgagaaaataaattgctgtattttcaagtcacgcaatttgtggtacttttctatggtggccctaagaaactaata

SEQ ID NO: 1013 - DNA, 500 bp, synthetic construct; identical to SEQ ID NO: 204
  misc_feature 1..500: note = Synthetic polypeptide
  source 1..500: mol_type = other DNA

SEQ ID NO: 1014 - DNA, 656 bp, synthetic construct; identical to SEQ ID NO: 205
  misc_feature 1..656: note = Synthetic polypeptide
  source 1..656: mol_type = other DNA

SEQ ID NO: 1015 - DNA, 524 bp, synthetic construct; identical to SEQ ID NO: 207
  misc_feature 1..524: note = Synthetic polypeptide
  source 1..524: mol_type = other DNA

SEQ ID NO: 1016 - DNA, 794 bp, synthetic construct
  misc_feature 1..794: note = Synthetic polypeptide
  source 1..794: mol_type = other DNA
atgaagtccagcaggaaaattcttctggcgtatttcattctgatgtttatagtatatgcctttgaagtggcatcttgtatcacagcagcaacacaacaagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactggacatggatgaagctggaagtcatcatcctcagcaaactaacacaggaacaggaagccagacactgcatgttccctctcataagtgggagttgaacaatgagaacacatggacaaagggaggggaacaacacacaccagggcctgctgaggggtgaggagtgaggagaagggaacttagaggatgggtcaacaggtgcagcaaaccaccatggcacacgtacatctgtgtaacaaacctgcacgttctgtacatgtatcctgtttttgttttggttttttagaagaaataaaaacaaacaa

SEQ ID NO: 1017 - DNA, 1034 bp, synthetic construct
  misc_feature 1..1034: note = Synthetic polypeptide
  source 1..1034: mol_type = other DNA
atggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacaagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactggacatggatgaagctggaagtcatcatcctcagcaaactaacacaggaacaggaagccagacactgcatgttccctctcataagtgggagttgaacaatgagaacacatggacaaagggaggggaacaacacacaccagggcctgctgaggggtgaggagtgaggagaagggaacttagaggatgggtcaacaggtgcagcaaaccaccatggcacacgtacatctgtgtaacaaacctgcacgttctgtacatgtatcctgtttttgttttggttttttagaagaaataaaaacaaacaa

SEQ ID NO: 1018 - DNA, 1010 bp, synthetic construct
  misc_feature 1..1010: note = Synthetic polypeptide
  source 1..1010: mol_type = other DNA
atggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacaagactttcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactggacatggatgaagctggaagtcatcatcctcagcaaactaacacaggaacaggaagccagacactgcatgttccctctcataagtgggagttgaacaatgagaacacatggacaaagggaggggaacaacacacaccagggcctgctgaggggtgaggagtgaggagaagggaacttagaggatgggtcaacaggtgcagcaaaccaccatggcacacgtacatctgtgtaacaaacctgcacgttctgtacatgtatcctgtttttgttttggttttttagaagaaataaaaacaaacaa

SEQ ID NO: 1019 - DNA, 359 bp, synthetic construct
  misc_feature 1..359: note = Synthetic polypeptide
  source 1..359: mol_type = other DNA
atggcgcttgacggaccagagcaggtatggcgggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagcaagggacccagcactcggtaaatgttcactgaatgaa

SEQ ID NO: 1020 - DNA, 590 bp, synthetic construct
  misc_feature 1..590: note = Synthetic polypeptide
  source 1..590: mol_type = other DNA
atggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagcaagggacccagcactcggtaaatgttcactgaatgaa

SEQ ID NO: 1021 - DNA, 566 bp, synthetic construct
  misc_feature 1..566: note = Synthetic polypeptide
  source 1..566: mol_type = other DNA
atggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagcaagggacccagcactcggtaaatgttcactgaatgaa

SEQ ID NO: 1022 - DNA, 533 bp, synthetic construct
  misc_feature 1..533: note = Synthetic polypeptide
  source 1..533: mol_type = other DNA
atggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagcaagggacccagcactcggtaaatgttcactgaatgaa

SEQ ID NO: 1023 - DNA, 154 bp, synthetic construct
  misc_feature 1..154: note = Synthetic polypeptide
  source 1..154: mol_type = other DNA
caacttatgagatgattggtggactggacaaacagatcaaggagatcaaagaagtgatcgagctgcctgttaagcatcctgagctcttcgaagcactgggcattgctcagcccaagcaagggacccagcactcggtaaatgttcactgaatgaa

SEQ ID NO: 1024 - DNA, 211 bp, synthetic construct
  misc_feature 1..211: note = Synthetic polypeptide
  source 1..211: mol_type = other DNA
atgacggaactagagacagccatgggcatgatcatagacgtcttttcccgatattcgggcagcgagggcagcacgcagaccctgaccaagggggagctcaaggtgctgatggagaaggagctaccaggcttcctgcagggcgatgcctctgccgtgtctggtggtgttgaggagttcctgtttgtgtaagcagctagttcagtgccagcac

SEQ ID NO: 1025 - DNA, 1834 bp, synthetic construct; identical to SEQ ID NO: 133
  misc_feature 1..1834: note = Synthetic polypeptide
  source 1..1834: mol_type = other DNA

SEQ ID NO: 1026 - DNA, 1765 bp, synthetic construct; identical to SEQ ID NO: 135
  misc_feature 1..1765: note = Synthetic polypeptide
  source 1..1765: mol_type = other DNA

SEQ ID NO: 1027 - DNA, 609 bp, synthetic construct; identical to SEQ ID NO: 249
  misc_feature 1..609: note = Synthetic polypeptide
  source 1..609: mol_type = other DNA

SEQ ID NO: 1028 - DNA, 738 bp, synthetic construct; identical to SEQ ID NO: 250
  misc_feature 1..738: note = Synthetic polypeptide
  source 1..738: mol_type = other DNA

SEQ ID NO: 1029 - DNA, 537 bp, synthetic construct; identical to SEQ ID NO: 251
  misc_feature 1..537: note = Synthetic polypeptide
  source 1..537: mol_type = other DNA

SEQ ID NO: 1030 - DNA, 684 bp, synthetic construct; identical to SEQ ID NO: 253
  misc_feature 1..684: note = Synthetic polypeptide
  source 1..684: mol_type = other DNA

SEQ ID NO: 1031 - DNA, 285 bp, synthetic construct; identical to SEQ ID NO: 255
  misc_feature 1..285: note = Synthetic polypeptide
  source 1..285: mol_type = other DNA

SEQ ID NO: 1032 - DNA, 552 bp, synthetic construct; identical to SEQ ID NO: 254
  misc_feature 1..552: note = Synthetic polypeptide
  source 1..552: mol_type = other DNA

SEQ ID NO: 1033 - DNA, 299 bp, synthetic construct
  misc_feature 1..299: note = Synthetic polypeptide
  source 1..299: mol_type = other DNA
atggctcttcctcagggtctattgacattcagggacgtggccatagaattctctcaggaggagtggaaatgcctggaccctgctcagaggactttatacagggacgtgatgctggagaattataggaacctcgtctccctgggcctctccactgagctctacaatcctgtgtgcagttgtctgctcacctctctgctgggacatcaaacaggcatctccaccttcacatgtccaaaagtgacttcctaaacccccaaacacattcccttgcagtctgcacatctcagatgagggtgact

SEQ ID NO: 1034 - DNA, 191 bp, synthetic construct
  misc_feature 1..191: note = Synthetic polypeptide
  source 1..191: mol_type = other DNA
atgctggagaattataggaacctcgtctccctgggcctctccactgagctctacaatcctgtgtgcagttgtctgctcacctctctgctgggacatcaaacaggcatctccaccttcacatgtccaaaagtgacttcctaaacccccaaacacattcccttgcagtctgcacatctcagatgagggtgact

SEQ ID NO: 1035 - DNA, 965 bp, synthetic construct
  misc_feature 1..965: note = Synthetic polypeptide
  source 1..965: mol_type = other DNA
atggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagtccgctgggaacatgacatggcacagccacgttggcagcccgttgggcagtggctcacaaagctcgatggacttgaaccacacatccccaaagtgtcacagatattgaacccactgatttgcaaactgacatccacatgaaaccagcatgccaggttcactgcttgactcctcgtcactcacacacggagccttcggggacggccttcaacacggggatggggagagcaaggctggtcctcccttcaaacggaagacccagtgagaaaagggaacgagccggtgatgcccgcacgaacgtgggtggatcctagatgcattttgctgagggacagaagccagacccaataagctaccaccgtaggattcccattcctaggccattctggaaaaggccaaaccacagggactgagaagcagtctgggtggccaggggctgacggatcggggagaggctgggtgcatagg

SEQ ID NO: 1036 - DNA, 725 bp, synthetic construct
  misc_feature 1..725: note = Synthetic polypeptide
  source 1..725: mol_type = other DNA
atgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagtccgctgggaacatgacatggcacagccacgttggcagcccgttgggcagtggctcacaaagctcgatggacttgaaccacacatccccaaagtgtcacagatattgaacccactgatttgcaaactgacatccacatgaaaccagcatgccaggttcactgcttgactcctcgtcactcacacacggagccttcggggacggccttcaacacggggatggggagagcaaggctggtcctcccttcaaacggaagacccagtgagaaaagggaacgagccggtgatgcccgcacgaacgtgggtggatcctagatgcattttgctgagggacagaagccagacccaataagctaccaccgtaggattcccattcctaggccattctggaaaaggccaaaccacagggactgagaagcagtctgggtggccaggggctgacggatcggggagaggctgggtgcatagg

SEQ ID NO: 1037 - DNA, 2161 bp, synthetic construct; identical to SEQ ID NO: 288
  misc_feature 1..2161: note = Synthetic polypeptide
  source 1..2161: mol_type = other DNA

SEQ ID NO: 1038 - DNA, 2140 bp, synthetic construct; identical to SEQ ID NO: 289
  misc_feature 1..2140: note = Synthetic polypeptide
  source 1..2140: mol_type = other DNA

SEQ ID NO: 1039 - DNA, 529 bp, synthetic construct; identical to SEQ ID NO: 287
  misc_feature 1..529: note = Synthetic polypeptide
  source 1..529: mol_type = other DNA

SEQ ID NO: 1040 - DNA, 1097 bp, synthetic construct
  misc_feature 1..1097: note = Synthetic polypeptide
  source 1..1097: mol_type = other DNA
atcattatgaaatacgaaaagggacaccgagctgggctgccagaggacaaggggcctaagccttttcgaagctacaacaacaacgtcgatcatttggggattgtacagtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagtccgctgggaacatgacatggcacagccacgttggcagcccgttgggcagtggctcacaaagctcgatggacttgaaccacacatccccaaagtgtcacagatattgaacccactgatttgcaaactgacatccacatgaaaccagcatgccaggttcactgcttgactcctcgtcactcacacacggagccttcggggacggccttcaacacggggatggggagagcaaggctggtcctcccttcaaacggaagacccagtgagaaaagggaacgagccggtgatgcccgcacgaacgtgggtggatcctagatgcattttgctgagggacagaagccagacccaataagctaccaccgtaggattcccattcctaggccattctggaaaaggccaaaccacagggactgagaagcagtctgggtggccaggggctgacggatcggggagaggctgggtgcatagg

SEQ ID NO: 1041 - DNA, 965 bp, synthetic construct
  misc_feature 1..965: note = Synthetic polypeptide
  source 1..965: mol_type = other DNA
atggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagtccgctgggaacatgacatggcacagccacgttggcagcccgttgggcagtggctcacaaagctcgatggacttgaaccacacatccccaaagtgtcacagatattgaacccactgatttgcaaactgacatccacatgaaaccagcatgccaggttcactgcttgactcctcgtcactcacacacggagccttcggggacggccttcaacacggggatggggagagcaaggctggtcctcccttcaaacggaagacccagtgagaaaagggaacgagccggtgatgcccgcacgaacgtgggtggatcctagatgcattttgctgagggacagaagccagacccaataagctaccaccgtaggattcccattcctaggccattctggaaaaggccaaaccacagggactgagaagcagtctgggtggccaggggctgacggatcggggagaggctgggtgcatagg

SEQ ID NO: 1042 - DNA, 1288 bp, synthetic construct
  misc_feature 1..1288: note = Synthetic polypeptide
  source 1..1288: mol_type = other DNA
atggtggacataatcgccaaagtgaccaggaggcagagtcgagccttgccggcacaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaagaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgaggtaggaatccagagccagagaggtgatattggtgcagttgttggcagtgctccggccacagctggaggtgcaggctcagaactgggagccacgtattgaggaatgctgac

SEQ ID NO: 1043 - DNA, 931 bp, synthetic construct
  misc_feature 1..931: note = Synthetic polypeptide
  source 1..931: mol_type = other DNA
atgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgaggtaggaatccagagccagagaggtgatattggtgcagttgttggcagtgctccggccacagctggaggtgcaggctcagaactgggagccacgtattgaggaatgctgac

SEQ ID NO: 1044 - DNA, 850 bp, synthetic construct
  misc_feature 1..850: note = Synthetic polypeptide
  source 1..850: mol_type = other DNA
atgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgaggtaggaatccagagccagagaggtgatattggtgcagttgttggcagtgctccggccacagctggaggtgcaggctcagaactgggagccacgtattgaggaatgctgac

SEQ ID NO: 1045 - DNA, 1954 bp, synthetic construct
  misc_feature 1..1954: note = Synthetic polypeptide
  source 1..1954: mol_type = other DNA
atggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgaggtaggaatccagagccagagaggtgatattggtgcagttgttggcagtgctccggccacagctggaggtgcaggctcagaactgggagccacgtattgaggaatgctgac

SEQ ID NO: 1046 - DNA, 1873 bp, synthetic construct
  misc_feature 1..1873: note = Synthetic polypeptide
  source 1..1873: mol_type = other DNA
atggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgaggtaggaatccagagccagagaggtgatattggtgcagttgttggcagtgctccggccacagctggaggtgcaggctcagaactgggagccacgtattgaggaatgctgac

SEQ ID NO: 1047 - DNA, 1888 bp, synthetic construct
  misc_feature 1..1888: note = Synthetic polypeptide
  source 1..1888: mol_type = other DNA
atggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaagaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgaggtaggaatccagagccagagaggtgatattggtgcagttgttggcagtgctccggccacagctggaggtgcaggctcagaactgggagccacgtattgaggaatgctgac

SEQ ID NO: 1048 - DNA, 1692 bp, synthetic construct
  misc_feature 1..1692: note = Synthetic polypeptide
  source 1..1692: mol_type = other DNA
atgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaaggcaccctccacttcctaatctacgtcagtactggttaatgttgcctgtccatcctttccacgctcctcccccgagaatgtcagccccttgaagctgcggtctgtctatgctggtcgtaccctcagagcctaaga

SEQ ID NO: 1049 - DNA, 1695 bp, synthetic construct
  misc_feature 1..1695: note = Synthetic polypeptide
  source 1..1695: mol_type = other DNA
atgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaaggcaccctccacttcctaatctacgtcagtactggttaatgttgcctgtccatcctttccacgctcctcccccgagaatgtcagccccttgaagctgcggtctgtctatgctggtcgtaccctcagagcctaaga

SEQ ID NO: 1050 - DNA, 466 bp, synthetic construct
  misc_feature 1..466: note = Synthetic polypeptide
  source 1..466: mol_type = other DNA
agcggtcactcgccccgtcacgtggcagctggagtacccaggccaggcccctgaagcagagaaggacaaaatggtgtgggaaatcctggtgtctgagcgggacatcagagcccttatcccactggccaaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaaggcaccctccacttcctaatctacgtcagtactggttaatgttgcctgtccatcctttccacgctcctcccccgagaatgtcagccccttgaagctgcggtctgtctatgctggtcgtaccctcagagcctaaga

SEQ ID NO: 1051 - DNA, 569 bp, synthetic construct; identical to SEQ ID NO: 426
  misc_feature 1..569: note = Synthetic polypeptide
  source 1..569: mol_type = other DNA

SEQ ID NO: 1052 - DNA, 258 bp, synthetic construct; identical to SEQ ID NO: 265
  misc_feature 1..258: note = Synthetic polypeptide
  source 1..258: mol_type = other DNA

SEQ ID NO: 1053 - DNA, 243 bp, synthetic construct; identical to SEQ ID NO: 267
  misc_feature 1..243: note = Synthetic polypeptide
  source 1..243: mol_type = other DNA

SEQ ID NO: 1054 - DNA, 324 bp, synthetic construct; identical to SEQ ID NO: 268
  misc_feature 1..324: note = Synthetic polypeptide
  source 1..324: mol_type = other DNA

SEQ ID NO: 1055 - DNA, 615 bp, synthetic construct
  misc_feature 1..615: note = Synthetic polypeptide
  source 1..615: mol_type = other DNA
atggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagatgagcgcttggataagagggtggatgacatgcttgctgctgggctcttggaggaactaagagattttcacagacgctataatcagaagaatgtttcggaaaatagatgaaatggctcaactaggtccatctccaaagcccctgctagcttt

SEQ ID NO: 1056 - DNA, 861 bp, synthetic construct
  misc_feature 1..861: note = Synthetic polypeptide
  source 1..861: mol_type = other DNA
atggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagatgaaatggctcaactaggtccatctccaaagcccctgctagcttt

SEQ ID NO: 1057 - DNA, 62 bp, synthetic construct
  misc_feature 1..62: note = Synthetic polypeptide
  source 1..62: mol_type = other DNA
atgtttcggaaaatagatgaaatggctcaactaggtccatctccaaagcccctgctagcttt

SEQ ID NO: 1058 - DNA, 123 bp, synthetic construct
  misc_feature 1..123: note = Synthetic polypeptide
  source 1..123: mol_type = other DNA
atgcttgctgctgggctcttggaggaactaagagattttcacagacgctataatcagaagaatgtttcggaaaatagatgaaatggctcaactaggtccatctccaaagcccctgctagcttt

SEQ ID NO: 1059 - DNA, 1839 bp, synthetic construct
  misc_feature 1..1839: note = Synthetic polypeptide
  source 1..1839: mol_type = other DNA
atggacagcgaggcattccagagcgcgcgggactttctggacatgaacttccagtcgctggccatgaaacacatggatctgaagcagatggagctggacacggcggcggccaaggtggatgaactgaccaagcagctggagtcgctgtggtcagactctcccgcgcctcctggcccgcaggccggacccccttctaggccgccccggtacagctccagctcgatccctgagcccttcggcagccgagggtccccccggaaggcggccaccgacggcgcagacaccccgttcggacgatcagagagtgccccaaccctacacccctacagcccgctgtcccccaagggacggccgtcgtcgccgcgcaccccgctctacctgcagccggacgcctacggcagcctggaccgcgcgacctcgccccggccccgcgccttcgatggcgcaggcagctccctcggccgtgcgccctccccgcggcccgggccaggcccgctccgccagcagggtccccccacgcctttcgacttcctgggccgcgcaggctccccccgcggcagccccctggcggaggggccccaggccttcttccccgagcgtgggccgtcaccgcgcccccctgccacagcctacgacgcgccagcgtccgccttcgggagctccctgctaggctccggcggcagcgcattcgccccgcctctgcgcgcgcaagacgacctgacgctgcgccggcggcctccgaaagcctggaacgagtctgacctggacgtggcgtacgagaagaagccttcgcagacagcgagctatgaacgcctggacgtcttcgcaaggcctgcctcgccgagcctgcagctgttgccttggagggagagcagcctggatggactggggggcaccggcaaggacaacctcactagcgccaccctgccgcgcaattacaaggtctctcctctggccagcgaccggcgttcagacgcgggcagctaccggcgctcgctgggctccgcggggccgtcgggcactttgcctcgcagctggcagcccgtcagccgcatccccatgcccccctccagcccccagccccgcggggccccgcgccagcgtcccatccccctcagcatgatcttcaagctgcagaacgccttctgggagcacggggccagccgcgccatgctccctgggtcccccctcttcacccgagcacccccgcctaagctgcagccccaaccacaaccacagccccagccacaatcacaaccacagccccagctgcccccacagccccagacccaaccccaaacccctaccccagccccccagcatccccaacagacatggccccctgtgaacgaaggaccccccaaaccccccaccgagctggagcctgagccggagatagaggggctgctgacaccagtgctggaggctggcgatgtggatgaaggccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggccggagccagagctgtcccccatcactgagggatctgaggccagggcagggccccctgctcctgccccaccagctcccattccacccccggccccgtcccagagcagcccaccagagcagccgcagagcatgatcatggatatactaacaatccct

SEQ ID NO: 1060 - DNA, 750 bp, synthetic construct
  misc_feature 1..750: note = Synthetic polypeptide
  source 1..750: mol_type = other DNA
atgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccgctgggcgtggttgtgtgcacctgtggtcccagctactcaggaggctgaggcaggaggatcgctcaagcccaggaggttgaggctgaagtgagccatgatggcaccactggactccagcctgggcgacagagggagaccctgtttc

SEQ ID NO: 1061 - DNA, 296 bp, synthetic construct
  misc_feature 1..296: note = Synthetic polypeptide
  source 1..296: mol_type = other DNA
agctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccgctgggcgtggttgtgtgcacctgtggtcccagctactcaggaggctgaggcaggaggatcgctcaagcccaggaggttgaggctgaagtgagccatgatggcaccactggactccagcctgggcgacagagggagaccctgtttc

SEQ ID NO: 1062 - DNA, 1412 bp, synthetic construct
  misc_feature 1..1412: note = Synthetic polypeptide
  source 1..1412: mol_type = other DNA
atgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaggaagaggcaccaggagcatgcacacacagggaagaaggacctgtgaggacacagcgagaagacagctgtctgcaagcccaggagagagccctccccagagaccagccctgctgccaccttgatcttggccttccagcttccagaactgtgagaaaattaatttcggtttttgaaggtccccaggctgtggcattttgctatggcagccgtagcagccaagtaca

SEQ ID NO: 1063 - DNA, 1430 bp, synthetic construct
  misc_feature 1..1430: note = Synthetic polypeptide
  source 1..1430: mol_type = other DNA
atgaaaggcttttcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaggaagaggcaccaggagcatgcacacacagggaagaaggacctgtgaggacacagcgagaagacagctgtctgcaagcccaggagagagccctccccagagaccagccctgctgccaccttgatcttggccttccagcttccagaactgtgagaaaattaatttcggtttttgaaggtccccaggctgtggcattttgctatggcagccgtagcagccaagtaca

SEQ ID NO: 1064 - DNA, 1496 bp, synthetic construct
  misc_feature 1..1496: note = Synthetic polypeptide
  source 1..1496: mol_type = other DNA
atgggtgaaactctgggagattctcctattgacccagaaagcgattccttcactgatacactgtctgcaaacatatcacaagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaggaagaggcaccaggagcatgcacacacagggaagaaggacctgtgaggacacagcgagaagacagctgtctgcaagcccaggagagagccctccccagagaccagccctgctgccaccttgatcttggccttccagcttccagaactgtgagaaaattaatttcggtttttgaaggtccccaggctgtggcattttgctatggcagccgtagcagccaagtaca

SEQ ID NO: 1065 - DNA, 2474 bp, synthetic construct
  misc_feature 1..2474: note = Synthetic polypeptide
  source 1..2474: mol_type = other DNA
atgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttgtggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccaagtgctgcgcaaagccaacaccagggtggatctcgtgactatggtcaccagcaagaacggtgggatttacttgctggccaaccagaagggttgtgacggggaccgcctgtactacgacggctgtgccatgattgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcacacaaagcctgtttggtggtctcttcacaccgatgcgagtga

SEQ ID NO: 1066 - DNA, 1694 bp, synthetic construct
  misc_feature 1..1694: note = Synthetic polypeptide
  source 1..1694: mol_type = other DNA
atgggcatctccggccaggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcacacaaagcctgtttggtggtctcttcacaccgatgcgagtga

SEQ ID NO: 1067 - DNA, 1361 bp, synthetic construct
  misc_feature 1..1361: note = Synthetic polypeptide
  source 1..1361: mol_type = other DNA
atgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcacacaaagcctgtttggtggtctcttcacaccgatgcgagtga

SEQ ID NO: 1068 - DNA, 688 bp, synthetic construct
  misc_feature 1..688: note = Synthetic polypeptide
  source 1..688: mol_type = other DNA
cggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcacacaaagcctgtttggtggtctcttcacaccgatgcgagtga

SEQ ID NO: 1069 - DNA, 531 bp, synthetic construct
  misc_feature 1..531: note = Synthetic polypeptide
  source 1..531: mol_type = other DNA
caagatgaccacgctcacacccgcgtaccacgccgagaactacagccctgaggacaacaggtttgatctgcgaccatttctgtacaacacaagctggccttggcagtttcggtgcatagaaaatcaggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcacacaaagcctgtttggtggtctcttcacaccgatgcgagtga

SEQ ID NO: 1070 - DNA, 610 bp, synthetic construct; identical to SEQ ID NO: 163
  misc_feature 1..610: note = Synthetic polypeptide
  source 1..610: mol_type = other DNA

SEQ ID NO: 1071 - DNA, 719 bp, synthetic construct; identical to SEQ ID NO: 367
  misc_feature 1..719: note = Synthetic polypeptide
  source 1..719: mol_type = other DNA

SEQ ID NO: 1072 - DNA, 716 bp, synthetic construct; identical to SEQ ID NO: 369
  misc_feature 1..716: note = Synthetic polypeptide
  source 1..716: mol_type = other DNA

SEQ ID NO: 1073 - DNA, 683 bp, synthetic construct; identical to SEQ ID NO: 372
  misc_feature 1..683: note = Synthetic polypeptide
  source 1..683: mol_type = other DNA

SEQ ID NO: 1074 - DNA, 1736 bp, synthetic construct; identical to SEQ ID NO: 156
  misc_feature 1..1736: note = Synthetic polypeptide
  source 1..1736: mol_type = other DNA

SEQ ID NO: 1075 - DNA, 1724 bp, synthetic construct; identical to SEQ ID NO: 157
  misc_feature 1..1724: note = Synthetic polypeptide
  source 1..1724: mol_type = other DNA

SEQ ID NO: 1076 - DNA, 775 bp, synthetic construct; identical to SEQ ID NO: 215
  misc_feature 1..775: note = Synthetic polypeptide
  source 1..775: mol_type = other DNA

SEQ ID NO: 1077 - DNA, 711 bp, synthetic construct
  misc_feature 1..711: note = Synthetic polypeptide
  source 1..711: mol_type = other DNA
atgaagatgcatttctgtatcccggtgtcccagcagcggtccgacgcgctggggggccgctacgtgctgtactccgtgcacctggacgggttcctcttctgcagggtgcgctacagccagctgcacggttggaacgaacagctaaggcgggtctttggaaattgcctgccacccttcccaccaaagtactatctggcaatgaccacagctatggctgatgagaggagggaccaactggaacaatatttgcaaaatgtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggtagaccctgaaaattatgtagttggccct

SEQ ID NO: 1078 - DNA, 414 bp, synthetic construct
  misc_feature 1..414: note = Synthetic polypeptide
  source 1..414: mol_type = other DNA
atgcttggaaatactgaaaactggaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggtagaccctgaaaattatgtagttggccct

SEQ ID NO: 1079 - DNA, 980 bp, synthetic construct; identical to SEQ ID NO: 139
  misc_feature 1..980: note = Synthetic polypeptide
  source 1..980: mol_type = other DNA

SEQ ID NO: 1080 - DNA, 1256 bp, synthetic construct; identical to SEQ ID NO: 140
  misc_feature 1..1256: note = Synthetic polypeptide
  source 1..1256: mol_type = other DNA

SEQ ID NO: 1081 - DNA, 1277 bp, synthetic construct; identical to SEQ ID NO: 142
  misc_feature 1..1277: note = Synthetic polypeptide
  source 1..1277: mol_type = other DNA

SEQ ID NO: 1082 - DNA, 128 bp, synthetic construct
  misc_feature 1..128: note = Synthetic polypeptide
  source 1..128: mol_type = other DNA
atggcctcggcccccgcggaggcggagacccgacagaggctgctacgcaccgtcaagaaggaggtcccttctcaaggtctcactttcctgctttctaagtggacgaggttggacagctccaggattcc

SEQ ID NO: 1083 - DNA, 734 bp, synthetic construct
  misc_feature 1..734: note = Synthetic polypeptide
  source 1..734: mol_type = other DNA
atggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggtgtggtggtacatacctgtagtctcagctactcgggagactgagatgggaggatcactgagcccagcaggtcaaggctacagtgagctgtgattgtgattgtgccactgcattccagcctggacaagagagcaagaccctatctcaaaaaaaaaaaaaaaa

SEQ ID NO: 1084 - DNA, 593 bp, synthetic construct
  misc_feature 1..593: note = Synthetic polypeptide
  source 1..593: mol_type = other DNA
atgaacgcactggcaaacatcccagacgtgccagtgaagtacagaaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggtgtggtggtacatacctgtagtctcagctactcgggagactgagatgggaggatcactgagcccagcaggtcaaggctacagtgagctgtgattgtgattgtgccactgcattccagcctggacaagagagcaagaccctatctcaaaaaaaaaaaaaaaa

SEQ ID NO: 1085 - DNA, 443 bp, synthetic construct
  misc_feature 1..443: note = Synthetic polypeptide
  source 1..443: mol_type = other DNA
tgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggtgtggtggtacatacctgtagtctcagctactcgggagactgagatgggaggatcactgagcccagcaggtcaaggctacagtgagctgtgattgtgattgtgccactgcattccagcctggacaagagagcaagaccctatctcaaaaaaaaaaaaaaaa

SEQ ID NO: 1086 - DNA, 418 bp, synthetic construct
  misc_feature 1..418: note = Synthetic polypeptide
  source 1..418: mol_type = other DNA
atggggccgcatcgtctatggatgtgcctttctgcttgttgtcctgctgtccatgctatgcctggtattggcccattggcccaaacgcctgttctctggagagctgatctacatcgcagcggctgtgttgctgctggtgctcattgtgggattcactttcaccgtctggagacagccccagagcaacactcctctttacttcaaggtccccctgttgcctgttctcctctggtcagcatctctgcacatgtttacctgatgatgcagatgaccactgagacctgggcccaatgtggagtctggatgttgattgtcccagctactcaggagatgaaggcaggagcatcgcttgagaccaggagctccagaccagcctgggcaacatggcgagactccacctctaccaaaataaaaaact

SEQ ID NO: 1087 - DNA, 606 bp, synthetic construct
  misc_feature 1..606: note = Synthetic polypeptide
  source 1..606: mol_type = other DNA
atgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagagcacccagcaccgtgtagaatcttcataagtgttagct

SEQ ID NO: 1088 - DNA, 663 bp, synthetic construct
  misc_feature 1..663: note = Synthetic polypeptide
  source 1..663: mol_type = other DNA
atgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatgggatgctggggagcctggtggcccaactgagcttcgccggtttcccatccatccagctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagagcacccagcaccgtgtagaatcttcataagtgttagct

SEQ ID NO: 1089 - DNA, 1098 bp, synthetic construct
  misc_feature 1..1098: note = Synthetic polypeptide
  source 1..1098: mol_type = other DNA
atgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgaggtgacctgcagctgccctttgcccgactccagcagctcctccgactc

SEQ ID NO: 1090 - DNA, 766 bp, synthetic construct
  misc_feature 1..766: note = Synthetic polypeptide
  source 1..766: mol_type = other DNA
atgaacccggtacctcagatggaaatgcagaaatcacccgtcttctgtgtcgctcacgctgggagctgtagaccggagctgttcctattcggacatcttggctcctccccaagagttctggagtctgagaagtcaaggatcggggtgctggcctattcagttcctgcatgcccccatcctgtgccgataagaactccagaccccaaactcagctcatacacacacggaagagagaagcatctgaacatcaagaagagaagaagctgctggacatcagaaactgtgaaaggagaggagtttggctgagctccaggggaagactgcctgcacattctatccccttttcagttccccatcctgctgtcagccacatttaccactcaataaaatcttcacattcaccatccttcaagtccgtgtgacctcattcctcttgggcactggacaaggacccagttgcgggtgcagtaggctgtcacactgactctccactgagctgtttaacacttaagttgtctgtagacagcaaagctaaaacagcacactgtaacacatgccctctggggctctagaggctgtggacagcccctagacgctgctgtgggctggtaaggagtttattcctgctggtgcccaaaggcactcaccccagctcctgcacccactcacctacatcttccccctctttcaaggggtttgagcactgcaggctgagtaagcgagccagcgcttcacaagccccatggggtcaagggaacccatctca

SEQ ID NO: 1091 - DNA, 890 bp, synthetic construct; identical to SEQ ID NO: 319
  misc_feature 1..890: note = Synthetic polypeptide
  source 1..890: mol_type = other DNA

SEQ ID NO: 1092 - DNA, 947 bp, synthetic construct; identical to SEQ ID NO: 320
  misc_feature 1..947: note = Synthetic polypeptide
  source 1..947: mol_type = other DNA

SEQ ID NO: 1093 - DNA, 1213 bp, synthetic construct
  misc_feature 1..1213: note = Synthetic polypeptide
  source 1..1213: mol_type = other DNA
atgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgaacttccatctgatcgacttcaacttgctgatggtgaccaccatcgttctgggccgccgcttcattgggtccatcgtgaaggaggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccactggaagctcctcaaggccaggatcacctcggaagcacatctgagtcttgggtccaggacaaggcttggcagagaggaggcccctaggacaggtttg

SEQ ID NO: 1094 - DNA, 616 bp, synthetic construct
  misc_feature 1..616: note = Synthetic polypeptide
  source 1..616: mol_type = other DNA
atgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccactggaagctcctcaaggccaggatcacctcggaagcacatctgagtcttgggtccaggacaaggcttggcagagaggaggcccctaggacaggtttg

SEQ ID NO: 1095 - DNA, 868 bp, synthetic construct
  misc_feature 1..868: note = Synthetic polypeptide
  source 1..868: mol_type = other DNA
atgaagaacttccatctgatcgacttcaacttgctgatggtgaccaccatcgttctgggccgccgcttcattgggtccatcgtgaaggaggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccactggaagctcctcaaggccaggatcacctcggaagcacatctgagtcttgggtccaggacaaggcttggcagagaggaggcccctaggacaggtttg

SEQ ID NO: 1096 - DNA, 506 bp, synthetic construct
  misc_feature 1..506: note = Synthetic polypeptide
  source 1..506: mol_type = other DNA
atgaaatatactaaacagaattttatgatgtcagttcttggcattataatctacgtaactgatttaattgtggacatatgggtatctgtcagatttttccatgaaggacagtatgtttttagtgctttagcgttaagctttatgctttttggaacacttgtggctcagtgttttagttattcttggttcaaggctgatttaaagaaagcaggccaagaaagtcagcattgttttcttctacttcattgcttgcaaggaggagtttttacaaggtattggtttgccttaaaaaggggttaccatgcagcttttaaatatgacagcaatactagtaacttcgtggaagaacaaattgatctacataaagaagttatagatagagtgactgatttgagcatgctcagactatttgagacctacctggaaggctgcccacaacttattcttcaactctacattcttctggagcatggacaagcgaatttcagtcagtattcaagaagccc

SEQ ID NO: 1097 - DNA, 3220 bp, synthetic construct; identical to SEQ ID NO: 248
  misc_feature 1..3220: note = Synthetic polypeptide
  source 1..3220: mol_type = other DNA

SEQ ID NO: 1098 - DNA, 533 bp, synthetic construct
  misc_feature 1..533: note = Synthetic polypeptide
  source 1..533: mol_type = other DNA
atggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagagcaggaccaaccctcccttcctcctcctcagcctgctctacgtgaagatgatgaggatgaagacctttatgacgatccacttccacttaatgaaaagtcagttcattttctcttccttgtgatttccttcattgcattttcttcctctagcttactttattataagaatccaatatataatacttgtaacatgcaaaatatatgttaatcgaccatttatgttattggcaaacattctggtcagcatcaggctatgagtaaattgtgggggagtcaaaaataatatgcagattttcaattgtgttgggggtggttcccccaacccctgagttgttcaaggattaactg

SEQ ID NO: 1099 - DNA, 1029 bp, synthetic construct
  misc_feature 1..1029: note = Synthetic polypeptide
  source 1..1029: mol_type = other DNA
atgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagcctggtgacagagtaagactccatctcgaacaacaaaaaaaaaagaa

SEQ ID NO: 1100 - DNA, 591 bp, synthetic construct
  misc_feature 1..591: note = Synthetic polypeptide
  source 1..591: mol_type = other DNA
atggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagcctggtgacagagtaagactccatctcgaacaacaaaaaaaaaagaa

SEQ ID NO: 1101 - DNA, 1352 bp, synthetic construct
  misc_feature 1..1352: note = Synthetic polypeptide
  source 1..1352: mol_type = other DNA
atgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtgggtcctagctggtgcattaaaacaagaaataagagatacaagaatcagaagaggagaaaccaaactgtcattgttttcagatgatatggttgtacctataaaacaccaaaacttttatagtcaaattaagaattaataagctagcttaccaacttgctcaatcaataaacaaaaattcaattgctcaattgctttttgaactctgggaaaccgaaaatgaacaaaaatttccattttctatggcatcaaaaaaataacaatactaacaatacagtgagcaaaaattatgcaaga

SEQ ID NO: 1102 - DNA, 1589 bp, synthetic construct
  misc_feature 1..1589: note = Synthetic polypeptide
  source 1..1589: mol_type = other DNA
atgaggagggagagaactaggggcccgcaggcctgggaatttccgtcccccaccaagtccggatgctcactccaaagtctcagcagggacctgagggagctcagggagggagagaagccagaagaccaggcagagactgaagagagctggcaaggcctggctagaaaaactccaggcaaggcctgtgcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtgggtcctagctggtgcattaaaacaagaaataagagatacaagaatcagaagaggagaaaccaaactgtcattgttttcagatgatatggttgtacctataaaacaccaaaacttttatagtcaaattaagaattaataagctagcttaccaacttgctcaatcaataaacaaaaattcaattgctcaattgctttttgaactctgggaaaccgaaaatgaacaaaaatttccattttctatggcatcaaaaaaataacaatactaacaatacagtgagcaaaaattatgcaaga

SEQ ID NO: 1103 - DNA, 2380 bp, synthetic construct
  misc_feature 1..2380: note = Synthetic polypeptide
  source 1..2380: mol_type = other DNA
atggccatgagatccgggaggcacccctcgctgctgctgcttctagtgctgctgctgtggctgctgcaggtcagtatcattgacagtgttcaacaggaaacagatgatcttactaagcaaacaaaggaaaagatctaccagcctctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcaggctggctgccgacctgaagggggactatctgcagagcttgggaagggaggcatccacagtggaatcctgtgttggaaggagccagagtccctcacactggcaggccaaaaaggcctggatccccaaacttttacaaaagagaaataaatgtaagtcagcatttgtgggggcactgtgttctgtcattcatcgtcgaacttaatactaa

SEQ ID NO: 1104 - DNA, 2503 bp, synthetic construct
  misc_feature 1..2503: note = Synthetic polypeptide
  source 1..2503: mol_type = other DNA
atggccatgagatccgggaggcacccctcgctgctgctgcttctagtgctgctgctgtggctgctgcaggtcagtatcattgacagtgttcaacaggaaacagatgatcttactaagcaaacaaaggaaaagatctaccagcctctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcaggctggctgccgacctgaagggggactatctgcagagcttgggaagggaggcatccacagtggaatcctgtgttggaaggagccagagtccctcacactggcaggccaaaaaggcctggatccccaaacttttacaaaagagaaataaatgtaagtcagcatttgtgggggcactgtgttctgtcattcatcgtcgaacttaatactaa

SEQ ID NO: 1105 - DNA, 1155 bp, synthetic construct
  misc_feature 1..1155: note = Synthetic polypeptide
  source 1..1155: mol_type = other DNA
ccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcaggctggctgccgacctgaagggggactatctgcagagcttgggaagggaggcatccacagtggaatcctgtgttggaaggagccagagtccctcacactggcaggccaaaaaggcctggatccccaaacttttacaaaagagaaataaatgtaagtcagcatttgtgggggcactgtgttctgtcattcatcgtcgaacttaatactaa

SEQ ID NO: 1106 - DNA, 379 bp, synthetic construct
  misc_feature 1..379: note = Synthetic polypeptide
  source 1..379: mol_type = other DNA
atgaaacctctgatatggacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcaggctggctgccgacctgaagggggactatctgcagagcttgggaagggaggcatccacagtggaatcctgtgttggaaggagccagagtccctcacactggcaggccaaaaaggcctggatccccaaacttttacaaaagagaaataaatgtaagtcagcatttgtgggggcactgtgttctgtcattcatcgtcgaacttaatactaa

SEQ ID NO: 1107 - DNA, 502 bp, synthetic construct
  misc_feature 1..502: note = Synthetic polypeptide
  source 1..502: mol_type = other DNA
atgaaacctctgatatggacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcaggctggctgccgacctgaagggggactatctgcagagcttgggaagggaggcatccacagtggaatcctgtgttggaaggagccagagtccctcacactggcaggccaaaaaggcctggatccccaaacttttacaaaagagaaataaatgtaagtcagcatttgtgggggcactgtgttctgtcattcatcgtcgaacttaatactaa

SEQ ID NO: 1108 - DNA, 433 bp, synthetic construct
  misc_feature 1..433: note = Synthetic polypeptide
  source 1..433: mol_type = other DNA
atgaaacctctgatatggacatggtcagatgttgaaggccagaggccggctctgctcatctgcacagctgcagcaggacccacgcagggagttaagggttatggcaagccctttgagccaagaagtgtgaaaaacatacactctactcctgcttacccagatgccacaatgcacagacaactcctggctccggtggaaggaaggatggcagagacattgaatcaggctggctgccgacctgaagggggactatctgcagagcttgggaagggaggcatccacagtggaatcctgtgttggaaggagccagagtccctcacactggcaggccaaaaaggcctggatccccaaacttttacaaaagagaaataaatgtaagtcagcatttgtgggggcactgtgttctgtcattcatcgtcgaacttaatactaa

SEQ ID NO: 1109 - DNA, 951 bp, synthetic construct
  misc_feature 1..951: note = Synthetic polypeptide
  source 1..951: mol_type = other DNA
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccgaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaat

SEQ ID NO: 1110 - DNA, 1036 bp, synthetic construct
  misc_feature 1..1036: note = Synthetic polypeptide
  source 1..1036: mol_type = other DNA
atggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccgaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaat

SEQ ID NO: 1111 - DNA, 871 bp, synthetic construct
  misc_feature 1..871: note = Synthetic polypeptide
  source 1..871: mol_type = other DNA
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccgaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaat

SEQ ID NO: 1112 - DNA, 577 bp, synthetic construct
  misc_feature 1..577: note = Synthetic polypeptide
  source 1..577: mol_type = other DNA
atggctactggggagctcggggacttgggtggctactacttcaggttcttgcctcagaaaaccttccagtctctgagctctaaggagatcaccagccggctccgccagtggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggaactgaagtgaaaaaaattgaagctataaatgttccttgcacacagctttcaatgtcattttttcatcggttatatgatgaagatattgtacgagacagtggacatattgttaaatgtttagattctttttgtgatccatttctcatttctgatgagttacgaagactgcctggaaggctgaagtcccagctgctcggaaggctgaagtgagaagattgagtctgggaagtcaaggctgcaatgagctgtgatcatgccactgcactccaacctgggcgacagagcaagaccttgtctcaaaaataaa

SEQ ID NO: 1113 - DNA, 252 bp, synthetic construct
  misc_feature 1..252: note = Synthetic polypeptide
  source 1..252: mol_type = other DNA
cattttttcatcggttatatgatgaagatattgtacgagacagtggacatattgttaaatgtttagattctttttgtgatccatttctcatttctgatgagttacgaagactgcctggaaggctgaagtcccagctgctcggaaggctgaagtgagaagattgagtctgggaagtcaaggctgcaatgagctgtgatcatgccactgcactccaacctgggcgacagagcaagaccttgtctcaaaaataaa

SEQ ID NO: 1114 - DNA, 763 bp, synthetic construct; identical to SEQ ID NO: 261
  misc_feature 1..763: note = Synthetic polypeptide
  source 1..763: mol_type = other DNA

SEQ ID NO: 1115 - DNA, 646 bp, synthetic construct; identical to SEQ ID NO: 262
  misc_feature 1..646: note = Synthetic polypeptide
  source 1..646: mol_type = other DNA

SEQ ID NO: 1116 - DNA, 224 bp, synthetic construct
  misc_feature 1..224: note = Synthetic polypeptide
  source 1..224: mol_type = other DNA
atggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagaa

SEQ ID NO: 1117 - DNA, 6132 bp, synthetic construct
  misc_feature 1..6132: note = Synthetic polypeptide
  source 1..6132: mol_type = other DNA
atgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagatgcagctgttctcttagttacattggcagattgtgtgttgtcaatgttgactattgcttagggaaccacagtatatcagtgcatggcctctgcctggccctttcgcacaattgtaactgtagcggtctgcaaagatatgaaaggaacatctgtgagatagatactgaagactgcaaatctgcgtcctgcaaaaatggaacaactagtacacatttaaggggatatttcttccgcaagtgtgtcccaggatttaaaggtacgcaatgtgaaattgatatagatgagtgtgcttcacatccctgcaaaaatggagccacctgcattgaccaacctggtaattacttctgccagtgtgtgcctccatttaaagtggttgatggcttttcctgcttatgcaatccaggctatgttgggataagatgtgaacaggacattgatgactgcatcctgaatgcctgtgagcacaattctacctgcaaagacctgcatctcagctaccagtgtgtgtgcctatctgattgggaaggaaatttttgtgaacaagaatccaatgagtgtaaaatgaatccttgcaagaacaattccacctgtactgacctttacaaaagctatcgatgtgagtgtacatctggatggactggacagaactgtagtgaagaaataaatgaatgcgactctgatccatgcatgaatggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaagaatttgaaggtaaaaactgtgaaattgatgtgaaagactgcctcttcctttcctgccaggattatggtgactgtgaagatatggtcaacaatttcaggtgtatttgcagacctgggttttctggatctctgtgtgaaattgaaattaatgaatgttcctctgaaccttgcaaaaataatggaacatgtgtggatctgacaaacagatttttttgtaattgtgaacctgagtaccatgggcccttctgtgaacttgatgtaaataaatgtaaaatctcaccttgtctagatgaagaaaattgtgtctacaggactgatggatacaactgcctctgtgcccctggttatacaggcatcaactgtgaaataaatctagatgaatgcctatcagagccctgtctccatgatggagtttgtatcgatggcatcaatcattatacctgtgactgcaagagtgggttttttggaacacactgtgaaacaaacgccaatgattgcctttcaaatccttgtctacatggaaggtgcacagaacttattaatgaatatccatgttcatgtgatgcagatgggactagcacacaatgtaagatcaaaattaatgactgcacatcaatcccttgtatgaatgaaggcttctgtcagaagtcagcacatggatttacttgcatttgcccacgtggatacactggtgcatactgtgaaaaaagcattgataattgtgctgagcctgaacttaattcagtcatctgtcttaatggagggatctgtgttgatgggcctggacatacttttgactgcagatgtcttcctggattttctggtcaattttgtgaaattaatataaatgaatgctcttcatcaccatgtctacatggtgcagactgtgaagatcacatcaatggatatgtttgcaaatgccaaccaggatggtctggacaccactgtgagaatgagcttgagtgcattcccaactcatgtgttcatgaactctgcatggagaatgaacctggctcgacatgtttatgcacacctggatttatgacctgctccattgggcttctttgtggtgatgaaataaggagaattacctgtttaactcccatctttcaaagaacagatcccatttccacacagacatatacaattcccccttctgagactttggtcagcagctttccatctataaaggctactagaataccagccataatggacacttacccagttgatcaaggtccaaaacagacaggcattgtcaagcacgacattctcccaaccactggtttggcaacattaagaattagcacacccttggaaagctacttactccaagaactgattgtcactagagagctttcagcaaaacacagtcttctttcttccgcagatgtttcctcttctcgattcctgaattttggtattcgtgacccagcacaaattgtccaggacaaaacatcggtatcacatatgcctattcgaacttcagcagccacactaggtttcttttttcctgataggagagcaaggaccccatttatcatgtcttccttaatgtcagattttatttttcctacacaatctttattatttgagaactgtcagactgttgctttatctgctaccccaacgacttcagtaattagaagcattccaggggctgatattgagctaaacaggcagtcattactctcccgtggattcctgcttatagctgcctccataagtgcaactccagttgtctctaggggggctcaagaggatattgaagaatattcagctgattctttaatttcaagaagagagcactggagattgctcagcccctcgatgtctcccatttttcctgctaaggtaattatatctaaacaggtaaccatcttaaactcatcagctctgcaccggttcagtacaaaagccttcaatcccagtgaatatcaggctattactgaggcttcaagcaaccagagactcacaaacatcaaatcacaggctgctgattctttaagagaattaagccaaacatgtgcaacatgttctatgactgaaataaaatcctctcgtgaattctcagatcaagttttgcatagcaaacagtcccacttttatgagacattctggatgaactcagcgatattagccagctggtatgcactaatgggagctcaaactatcacttctgggcattcattttcttctgctactgaaataacaccatcagtggcattcacagaagtgccatctttatttccttctaaaaagagtgcaaaaagaacaattttatcctcatccttggaagaatccattaccctatcaagtaatttggatgttaatttatgtttggataagacttgtttatccattgtcccttcacaaactatctcttcagacttgatgaattctgatttgacttcaaaaatgactactgatgaactgtcagtatcagaaaacattttaaaactattgaaaataagacaatatggcataactatgggacccactgaggtactaaatcaagagagcttattggacatggaaaaaagtaaaggatctcatacactgttcaaacttcacccaagtgatagttctctggattttgagttaaacttacaaatttatccggatgttactttaaagacatattcagaaattacacatgcaaatgacttcaaaaataatctgccaccattgacaggctcagtgcctgatttttcagaagtcaccaccaatgttgcattttatacagtttcagcaactccagcactttcaatacagacgtcttcctccatgtctgtaattaggccagattggccatattttacagattatatgacctctcttaaaaaagaggtcaagacttcttcagaatggtccaaatgggaacttcagcctagtgtgcaatatcaggaatttcccactgcaagccggcatcttcccttcactagatctcttactttgtcttcactggaatccattctggcacctcaacggctgatgatttctgatttcagttgtgttcgttattatggagattcttatctagaatttcagaatgtggctttaaatccacaaaataacatctccctagaatttcagaccttcagctcctatggacttctgctgtatgtcaagcaagactcaaatttagtagatggattttttattcaattgtttattgaaaatggtactttaaagtaccacttttactgtcctggtgaagcaaaatttaaaagcattaatactactgttagagtggacaacgggcaaaagtatacactgcttatcaggcaagaattggatccatgtaacgctgagctgactattttagggaggaatacacaaatatgcgaatctatcaatcatgtactcggaaaacccctgccaaaatcaggatctgtcttcattggtggatttccagaccttcatgggaaaatccaggcaaggacagttcctgtcacattgttggagttcaatgaacagcttttaaataaa

SEQ ID NO: 1118 - DNA, 1394 bp, synthetic construct
  misc_feature 1..1394: note = Synthetic polypeptide
  source 1..1394: mol_type = other DNA
atgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatggaaacagggatcataagcttgctgcccccttggggtggtcgcccaagtgcagtaaggaagcgcttgcgcagcgcctggcgcgggccggcccgcagggagcgcgcggtaaccgg

SEQ ID NO: 1119 - DNA, 1625 bp, synthetic construct
  misc_feature 1..1625: note = Synthetic polypeptide
  source 1..1625: mol_type = other DNA
atgaattcagtcctgacaaaacatgggtctccacctcgaagctggctcagcctttgttcaggaaccgacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatggaaacagggatcataagcttgctgcccccttggggtggtcgcccaagtgcagtaaggaagcgcttgcgcagcgcctggcgcgggccggcccgcagggagcgcgcggtaaccgg

SEQ ID NO: 1120 - DNA, 1505 bp, synthetic construct
  misc_feature 1..1505: note = Synthetic polypeptide
  source 1..1505: mol_type = other DNA
atggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatggaaacagggatcataagcttgctgcccccttggggtggtcgcccaagtgcagtaaggaagcgcttgcgcagcgcctggcgcgggccggcccgcagggagcgcgcggtaaccgg

SEQ ID NO: 1121 - DNA, 1562 bp, synthetic construct
  misc_feature 1..1562: note = Synthetic polypeptide
  source 1..1562: mol_type = other DNA
atggacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatggaaacagggatcataagcttgctgcccccttggggtggtcgcccaagtgcagtaaggaagcgcttgcgcagcgcctggcgcgggccggcccgcagggagcgcgcggtaaccgg

SEQ ID NO: 1122 - DNA, 1601 bp, synthetic construct
  misc_feature 1..1601: note = Synthetic polypeptide
  source 1..1601: mol_type = other DNA
atggggacaggacccggtgtctccggacgcctagcagcctccaggccgggcccggggctgcccctccgggactcggagccctcctgggccgggggtcgtgcccgcgacggtgatagccaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatggaaacagggatcataagcttgctgcccccttggggtggtcgcccaagtgcagtaaggaagcgcttgcgcagcgcctggcgcgggccggcccgcagggagcgcgcggtaaccgg

SEQ ID NO: 1123 - DNA, 1631 bp, synthetic construct
  misc_feature 1..1631: note = Synthetic polypeptide
  source 1..1631: mol_type = other DNA
atgagtcttggggaacgggggtcgccccagaccttcgggggctcctctgtctctaaagggagcgatgcagggcacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatggaaacagggatcataagcttgctgcccccttggggtggtcgcccaagtgcagtaaggaagcgcttgcgcagcgcctggcgcgggccggcccgcagggagcgcgcggtaaccgg

SEQ ID NO: 1124 - DNA, 2151 bp, synthetic construct; identical to SEQ ID NO: 127
  misc_feature 1..2151: note = Synthetic polypeptide
  source 1..2151: mol_type = other DNA

SEQ ID NO: 1125 - DNA, 1833 bp, synthetic construct; identical to SEQ ID NO: 126
  misc_feature 1..1833: note = Synthetic polypeptide
  source 1..1833: mol_type = other DNA

SEQ ID NO: 1126 - DNA, 503 bp, synthetic construct; identical to SEQ ID NO: 322
  misc_feature 1..503: note = Synthetic polypeptide
  source 1..503: mol_type = other DNA

SEQ ID NO: 1127 - DNA, 951 bp, synthetic construct
  misc_feature 1..951: note = Synthetic polypeptide
  source 1..951: mol_type = other DNA
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccgaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaat

SEQ ID NO: 1128 - DNA, 1036 bp, synthetic construct
  misc_feature 1..1036: note = Synthetic polypeptide
  source 1..1036: mol_type = other DNA
atggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccgaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaat

SEQ ID NO: 1129 - DNA, 871 bp, synthetic construct
  misc_feature 1..871: note = Synthetic polypeptide
  source 1..871: mol_type = other DNA
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccgaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaat

SEQ ID NO: 1130 - DNA, 473 bp, synthetic construct
  misc_feature 1..473: note = Synthetic polypeptide
  source 1..473: mol_type = other DNA
atggcggacggcgtggaccacatagacatttacgcggatgtcggcgaagagttcaaccaggaagctgaatatgagagagaagcagagaacgagagaggcaccgggatcgtgaccgagaccgtgaccgagagcgtgaccgagagcgcgaatatcgtcatcgttagaaggttaggtatcgtcatgtgtctgagccgttgtgtgggccatttcccctgcctggaatgctggagatagctgcctgagaagaatctcagtgaggtttgtttttaccattctattgaatggaaactgctacctcccttaattgctttattctttactcttcccatgcatttatgacctagcactatgtattttgcttgttcgttcaaatataaagtcccatgaaagcaaggatcttattgtagtttctgttaaatcccaagtgtctacatcagcttgtggcaagcaaatgttaatatttgaatgaagga

SEQ ID NO: 1131 - DNA, 1035 bp, synthetic construct
  misc_feature 1..1035: note = Synthetic polypeptide
  source 1..1035: mol_type = other DNA
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1132 - DNA, 996 bp, synthetic construct
  misc_feature 1..996: note = Synthetic polypeptide
  source 1..996: mol_type = other DNA
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1133 - DNA, 1047 bp, synthetic construct
  misc_feature 1..1047: note = Synthetic polypeptide
  source 1..1047: mol_type = other DNA
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1134 - DNA, 1137 bp, synthetic construct
  misc_feature 1..1137: note = Synthetic polypeptide
  source 1..1137: mol_type = other DNA
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattggggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1135 - DNA, 1005 bp, synthetic construct
  misc_feature 1..1005: note = Synthetic polypeptide
  source 1..1005: mol_type = other DNA
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcagttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1136 - DNA, 1140 bp, synthetic construct
  misc_feature 1..1140: note = Synthetic polypeptide
  source 1..1140: mol_type = other DNA
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1137 - DNA, 1128 bp, synthetic construct
  misc_feature 1..1128: note = Synthetic polypeptide
  source 1..1128: mol_type = other DNA
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1138 - DNA, 1125 bp, synthetic construct
  misc_feature 1..1125: note = Synthetic polypeptide
  source 1..1125: mol_type = other DNA
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattggggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1139 - DNA, 1008 bp, synthetic construct
  misc_feature 1..1008: note = Synthetic polypeptide
  source 1..1008: mol_type = other DNA
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1140 - DNA, 943 bp, synthetic construct
  misc_feature 1..943: note = Synthetic polypeptide
  source 1..943: mol_type = other DNA
gcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcagttgaccaagctgcaccagttggcaatgcaacagtctcattttcccatgacgcatggcaacaccggattcagtggcattgaatccagctctccagaggtgaaaggctattggggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1141 - DNA, 660 bp, synthetic construct
  misc_feature 1..660: note = Synthetic polypeptide
  source 1..660: mol_type = other DNA
agtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1142 - DNA, 593 bp, synthetic construct
  misc_feature 1..593: note = Synthetic polypeptide
  source 1..593: mol_type = other DNA
tgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1143 - DNA, 7808 bp, synthetic construct
  misc_feature 1..7808: note = Synthetic polypeptide
  source 1..7808: mol_type = other DNA
atgttccgcagggcacgccttagcgtgaagccgaatgtcaggcctggtgtaggcgccaggggctccacagcttccaatccccagcgtggacgggagtctcccaggccgccggatcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatcatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctgtgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccaagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcatgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatgtaggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcagtccaccagggatcctggcaggctgcaagtggtgcctcgaacagcaacagaatctggtgctttaca

SEQ ID NO: 1144 - DNA, 1874 bp, synthetic construct
  misc_feature 1..1874: note = Synthetic polypeptide
  source 1..1874: mol_type = other DNA
acagatgtgactactgaagaaatgaaacaagaagaaaatttgagtgtaccgtttgaaatgaccacaagtgaacatatccaagatgaaccaggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcagtccaccagggatcctggcaggctgcaagtggtgcctcgaacagcaacagaatctggtgctttaca

SEQ ID NO: 1145 - DNA, 53 bp, synthetic construct
  misc_feature 1..53: note = Synthetic polypeptide
  source 1..53: mol_type = other DNA
atgggtcgcaggaacagtcttctcaactagactgaactccttaagtgcaagaa

SEQ ID NO: 1146 - DNA, 183 bp, synthetic construct
  misc_feature 1..183: note = Synthetic polypeptide
  source 1..183: mol_type = other DNA
atgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacagtcttctcaactagactgaactccttaagtgcaagaa

SEQ ID NO: 1147 - DNA, 163 bp, synthetic construct; identical to SEQ ID NO: 351
  misc_feature 1..163: note = Synthetic polypeptide
  source 1..163: mol_type = other DNA

SEQ ID NO: 1148 - DNA, 222 bp, synthetic construct; identical to SEQ ID NO: 355
  misc_feature 1..222: note = Synthetic polypeptide
  source 1..222: mol_type = other DNA

SEQ ID NO: 1149 - DNA, 721 bp, synthetic construct; identical to SEQ ID NO: 414
  misc_feature 1..721: note = Synthetic polypeptide
  source 1..721: mol_type = other DNA

SEQ ID NO: 1150 - DNA, 3934 bp, synthetic construct
  misc_feature 1..3934: note = Synthetic polypeptide
  source 1..3934: mol_type = other DNA
atggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgcgcggtggctcacgtctgtaatcccagcactttgggaggctgaggaaggcggatcatgaggtcaggagatcgagaccatcctggctaacacggtgaaaccccgtctctactaaaaatacaaaaagattagccaggcgtggtggcgggcccctgtagtcccagctactcaggaggctgaggcgggagaatggcgtgaccccaggaggcagagcttgcagtgagcggagatcgcgccactgcactccagcctgggtgacagagcgagactccgtctcaaaaaaaaaaaaaa

SEQ ID NO: 1151 - DNA, 3787 bp, synthetic construct
  misc_feature 1..3787: note = Synthetic polypeptide
  source 1..3787: mol_type = other DNA
atggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgcgcggtggctcacgtctgtaatcccagcactttgggaggctgaggaaggcggatcatgaggtcaggagatcgagaccatcctggctaacacggtgaaaccccgtctctactaaaaatacaaaaagattagccaggcgtggtggcgggcccctgtagtcccagctactcaggaggctgaggcgggagaatggcgtgaccccaggaggcagagcttgcagtgagcggagatcgcgccactgcactccagcctgggtgacagagcgagactccgtctcaaaaaaaaaaaaaa

SEQ ID NO: 1152 - DNA, 867 bp, synthetic construct
  misc_feature 1..867: note = Synthetic polypeptide
  source 1..867: mol_type = other DNA
cacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgcgcggtggctcacgtctgtaatcccagcactttgggaggctgaggaaggcggatcatgaggtcaggagatcgagaccatcctggctaacacggtgaaaccccgtctctactaaaaatacaaaaagattagccaggcgtggtggcgggcccctgtagtcccagctactcaggaggctgaggcgggagaatggcgtgaccccaggaggcagagcttgcagtgagcggagatcgcgccactgcactccagcctgggtgacagagcgagactccgtctcaaaaaaaaaaaaaa

SEQ ID NO: 1153 - DNA, 996 bp, synthetic construct
  misc_feature 1..996: note = Synthetic polypeptide
  source 1..996: mol_type = other DNA
gtatcaacgtgaccgtgggtggtgagagctgccagcacgagttccggggggacatggttgtctgccccctgcccccatccctgcagcttggccaggatggtgccccattgcaggtctgcgtagatgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgcgcggtggctcacgtctgtaatcccagcactttgggaggctgaggaaggcggatcatgaggtcaggagatcgagaccatcctggctaacacggtgaaaccccgtctctactaaaaatacaaaaagattagccaggcgtggtggcgggcccctgtagtcccagctactcaggaggctgaggcgggagaatggcgtgaccccaggaggcagagcttgcagtgagcggagatcgcgccactgcactccagcctgggtgacagagcgagactccgtctcaaaaaaaaaaaaaa

SEQ ID NO: 1154 - DNA, 1194 bp, synthetic construct
  misc_feature 1..1194: note = Synthetic polypeptide
  source 1..1194: mol_type = other DNA
atgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaaccgtactggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgttctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggaaagtttaccaaccc

SEQ ID NO: 1155 - DNA, 1705 bp, synthetic construct
  misc_feature 1..1705: note = Synthetic polypeptide
  source 1..1705: mol_type = other DNA
atgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggatgttttgaataatttgggatcttgtgaactggatgaagatgatctaatgcttgatcttgaatttttagaggaacagagtcttcacccttctgaactaccgcaggaacataccaggaaagccaagagaatccacagacctttgaaggaattggatcaccgccacaggctccctgagatggcaaaaaactgtgagt

SEQ ID NO: 1156 - DNA, 1111 bp, synthetic construct
  misc_feature 1..1111: note = Synthetic polypeptide
  source 1..1111: mol_type = other DNA
atggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggaggaataatattggccttgcagggttgttgtgattactcaggaaagcaagactagtcaagcactttgcacagggcctggcacatagtagatgctcaacaaatactgctgtgtt

SEQ ID NO: 1157 - DNA, 1138 bp, synthetic construct
  misc_feature 1..1138: note = Synthetic polypeptide
  source 1..1138: mol_type = other DNA
atggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggaggaataatattggccttgcagggttgttgtgattactcaggaaagcaagactagtcaagcactttgcacagggcctggcacatagtagatgctcaacaaatactgctgtgtt

SEQ ID NO: 1158 - DNA, 1345 bp, synthetic construct
  misc_feature 1..1345: note = Synthetic polypeptide
  source 1..1345: mol_type = other DNA
atggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggaggaataatattggccttgcagggttgttgtgattactcaggaaagcaagactagtcaagcactttgcacagggcctggcacatagtagatgctcaacaaatactgctgtgtt

SEQ ID NO: 1159 - DNA, 1249 bp, synthetic construct
  misc_feature 1..1249: note = Synthetic polypeptide
  source 1..1249: mol_type = other DNA
atggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggaggaataatattggccttgcagggttgttgtgattactcaggaaagcaagactagtcaagcactttgcacagggcctggcacatagtagatgctcaacaaatactgctgtgtt

SEQ ID NO: 1160 - DNA, 3628 bp, synthetic construct; identical to SEQ ID NO: 330
  misc_feature 1..3628: note = Synthetic polypeptide
  source 1..3628: mol_type = other DNA

SEQ ID NO: 1161 - DNA, 3127 bp, synthetic construct; identical to SEQ ID NO: 332
  misc_feature 1..3127: note = Synthetic polypeptide
  source 1..3127: mol_type = other DNA

SEQ ID NO: 1162 - DNA, 3881 bp, synthetic construct
  misc_feature 1..3881: note = Synthetic polypeptide
  source 1..3881: mol_type = other DNA
atggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaaggcccacgatgccagcaggatgtggacgagtgtgctggccccgcaccctgtggccctcatggtatctgcaccaacctggcagggagtttcagctgcacctgccatggagggtacactggcccttcctgcgatcaggacatcaatgactgtgaccccaacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagcctggcgactgagtgacactccgtctcaaaaaacaaagaaacaa

SEQ ID NO: 1163 - DNA, 3722 bp, synthetic construct
  misc_feature 1..3722: note = Synthetic polypeptide
  source 1..3722: mol_type = other DNA
gggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagcctggcgactgagtgacactccgtctcaaaaaacaaagaaacaa

SEQ ID NO: 1164 - DNA, 2501 bp, synthetic construct
  misc_feature 1..2501: note = Synthetic polypeptide
  source 1..2501: mol_type = other DNA
atggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaaggaactgcctcctcacttggcttctctccccctgccctgcccccagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgagcaggggctccagaccccagggatgtggcagagctgccaacttcctgtgtgactccagcaagtcaggcttgcctacctgggcctcagtttccctacttgtaaaatgagaagaattgcccacgccacgtctgcctc

SEQ ID NO: 1165 - DNA, 2552 bp, synthetic construct
  misc_feature 1..2552: note = Synthetic polypeptide
  source 1..2552: mol_type = other DNA
atggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgcctctccgcagctcagcacagggcagcgacatcccagctcgaaggccgggtggtgagacgggtgctcactgtggcctcgcgtgctctgtgtcccacaggagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgagcaggggctccagaccccagggatgtggcagagctgccaacttcctgtgtgactccagcaagtcaggcttgcctacctgggcctcagtttccctacttgtaaaatgagaagaattgcccacgccacgtctgcctc

SEQ ID NO: 1166 - DNA, 2456 bp, synthetic construct
  misc_feature 1..2456: note = Synthetic polypeptide
  source 1..2456: mol_type = other DNA
atggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgagcaggggctccagaccccagggatgtggcagagctgccaacttcctgtgtgactccagcaagtcaggcttgcctacctgggcctcagtttccctacttgtaaaatgagaagaattgcccacgccacgtctgcctc

SEQ ID NO: 1167 - DNA, 588 bp, synthetic construct
  misc_feature 1..588: note = Synthetic polypeptide
  source 1..588: mol_type = other DNA
tccggcccctgcggaagcaggtggagctgctcttcaacacacgatacggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgagcaggggctccagaccccagggatgtggcagagctgccaacttcctgtgtgactccagcaagtcaggcttgcctacctgggcctcagtttccctacttgtaaaatgagaagaattgcccacgccacgtctgcctc

SEQ ID NO: 1168 - DNA, 586 bp, synthetic construct; identical to SEQ ID NO: 401
  misc_feature 1..586: note = Synthetic polypeptide
  source 1..586: mol_type = other DNA

SEQ ID NO: 1169 - DNA, 829 bp, synthetic construct; identical to SEQ ID NO: 402
  misc_feature 1..829: note = Synthetic polypeptide
  source 1..829: mol_type = other DNA

SEQ ID NO: 1170 - DNA, 1060 bp, synthetic construct; identical to SEQ ID NO: 403
  misc_feature 1..1060: note = Synthetic polypeptide
  source 1..1060: mol_type = other DNA

SEQ ID NO: 1171 - DNA, 730 bp, synthetic construct; identical to SEQ ID NO: 406
  misc_feature 1..730: note = Synthetic polypeptide
  source 1..730: mol_type = other DNA

SEQ ID NO: 1172 - DNA, 496 bp, synthetic construct; identical to SEQ ID NO: 408
  misc_feature 1..496: note = Synthetic polypeptide
  source 1..496: mol_type = other DNA

SEQ ID NO: 1173 - DNA, 321 bp, synthetic construct
  misc_feature 1..321: note = Synthetic polypeptide
  source 1..321: mol_type = other DNA
atgcccatggcggggcttctaaaggggcttgtacggcaactggagcggttcagcgttcaacaacaagcttccaagatgccgcccaaaggaaaaagtggttctggaaaagcggggaaaggaaaccttccctggctggctccagtgtccctctgtgcttccacagccccctgtccataaccatctctgcatctcctgcattctcctgaaatgatccgtcttcctcactagaatatgagttttctgaaggaaggtacatggcttgttcatctttgtactcccagtgcctggaactcagtagttgtataggaaatgtttattgaa

SEQ ID NO: 1174 - DNA, 267 bp, synthetic construct
  misc_feature 1..267: note = Synthetic polypeptide
  source 1..267: mol_type = other DNA
gttcaacaacaagcttccaagatgccgcccaaaggaaaaagtggttctggaaaagcggggaaaggaaaccttccctggctggctccagtgtccctctgtgcttccacagccccctgtccataaccatctctgcatctcctgcattctcctgaaatgatccgtcttcctcactagaatatgagttttctgaaggaaggtacatggcttgttcatctttgtactcccagtgcctggaactcagtagttgtataggaaatgtttattgaa

SEQ ID NO: 1175 - DNA, 238 bp, synthetic construct
  misc_feature 1..238: note = Synthetic polypeptide
  source 1..238: mol_type = other DNA
caaaggaaaaagtggttctggaaaagcggggaaaggaaaccttccctggctggctccagtgtccctctgtgcttccacagccccctgtccataaccatctctgcatctcctgcattctcctgaaatgatccgtcttcctcactagaatatgagttttctgaaggaaggtacatggcttgttcatctttgtactcccagtgcctggaactcagtagttgtataggaaatgtttattgaa

SEQ ID NO: 1176 - DNA, 639 bp, synthetic construct
  misc_feature 1..639: note = Synthetic polypeptide
  source 1..639: mol_type = other DNA
atgagcatatcatcagccttggccatggttttcatgggggcaaagggaaacactgcagctcagatgtctcaggcactttgttttagtaaaatcggaggtgaagatggagatattcatcgaggttttcagtcacttcttgttgcaattaacagaactgacactgaatatgtgcttagaactgccaacgggctctttggagaaaagtcttatgatttcctcacaggttttacagattcctgtggcaaattctaccaagcaacgataaaacagctagactttgtgaatgatacagagaagtccacaacacgtgtaaactcctgggttgctgataaaactaaagcctggaaaattattcaaacaagcctgtcacatctggaggagccaggaatcgcctcttcctcttgttactgcaaagcctgccttccacagcccctactggttcactctattcccaaatgcaactctcctgtgaccccgcatggcatgtggtgacctccctccctgtgagcagttgtgactaataaactgccgccaatttcatctgtccagtgtgtcatgccatgtgtctagttatctcctactatttaatgggggagatccctccttcaccaacaaggtgaatatgagacaatcaaaaca

SEQ ID NO: 1177 - DNA, 2869 bp, synthetic construct
  misc_feature 1..2869: note = Synthetic polypeptide
  source 1..2869: mol_type = other DNA
atggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagatgtgaccatctagttgcaggaaaacaagctcagggctgtcactgattccacattgtggtgagttgtataattattttattatatatcacaatgtaatagaaataaagtacacaataaatgtaatacacttgaatcatccctaaaccatcgcccccacccccaggtcagtggaaaaatggtcttccatgaaaccagttcctggtgccaaaaagtgtggggactgctg

SEQ ID NO: 1178 - DNA, 340 bp, synthetic construct
  misc_feature 1..340: note = Synthetic polypeptide
  source 1..340: mol_type = other DNA
atggctcttcctcagggtctattgacattcagggacgtggccatagaattctctcaggaggagtggaaatgcctggaccctgctcagaggactttatacagggacgtgatgctggagaattataggaacctcgtctccctgggcctctccactgagctctacaatcctgtgtccagttgtctcctcagctctctgctgggacatcaaacaggcatctccaccttcacgtgtccataagtgacttcctaaacccccaaacacattcccttgcagtcctacacgtctcagatgagggtgactgtgtacttctggggacttagccaaacttgacagcatgttt

SEQ ID NO: 1179 - DNA, 232 bp, synthetic construct
  misc_feature 1..232: note = Synthetic polypeptide
  source 1..232: mol_type = other DNA
atgctggagaattataggaacctcgtctccctgggcctctccactgagctctacaatcctgtgtccagttgtctcctcagctctctgctgggacatcaaacaggcatctccaccttcacgtgtccataagtgacttcctaaacccccaaacacattcccttgcagtcctacacgtctcagatgagggtgactgtgtacttctggggacttagccaaacttgacagcatgttt

SEQ ID NO: 1180 - DNA, 417 bp, synthetic construct
  misc_feature 1..417: note = Synthetic polypeptide
  source 1..417: mol_type = other DNA
atggctcttcctcagggtctattgacattcagggacgtggccatagaattctctcaggaggagtggaaatgcctggaccctgctcagaggactttatacagggacgtgatgctggagaattataggaacctcgtctccctggagttttggtctgtcatcccggctaaagtacagtggtgtcatctccgctcactgcaacctccacttcccaggttcaagcaattctcctgcctcagccttccaagtacctgggactacaggcctctccactgagctctacaatcctgtgtgcagttgtctgctcacctctctgctgggacatcaaacaggcatctccaccttcacatgtccaaaagtgacttcctaaacccccaaacacattcccttgcagtctgcacatctcagatgagggtgact

SEQ ID NO: 1181 - DNA, 715 bp, synthetic construct
  misc_feature 1..715: note = Synthetic polypeptide
  source 1..715: mol_type = other DNA
atggccgcgggagccgggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcaggctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagcttgaatatcagcaaatataacctacataaacagaaagctctttgagggtctgcagtaacgttttaagaagaatataaaagaatcctgagaccaaaaatttgagacctgct

SEQ ID NO: 1182 - DNA, 589 bp, synthetic construct
  misc_feature 1..589: note = Synthetic polypeptide
  source 1..589: mol_type = other DNA
atggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcaggctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagcttgaatatcagcaaatataacctacataaacagaaagctctttgagggtctgcagtaacgttttaagaagaatataaaagaatcctgagaccaaaaatttgagacctgct

SEQ ID NO: 1183 - DNA, 352 bp, synthetic construct
  misc_feature 1..352: note = Synthetic polypeptide
  source 1..352: mol_type = other DNA
atgtcttctctcccagctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagcttgaatatcagcaaatataacctacataaacagaaagctctttgagggtctgcagtaacgttttaagaagaatataaaagaatcctgagaccaaaaatttgagacctgct

SEQ ID NO: 1184 - DNA, 180 bp, synthetic construct
  misc_feature 1..180: note = Synthetic polypeptide
  source 1..180: mol_type = other DNA
agatgattaaaacggaatttacactgacagaagcagtggtcgaatccagtagaaaactggtcaaggaagcttgaatatcagcaaatataacctacataaacagaaagctctttgagggtctgcagtaacgttttaagaagaatataaaagaatcctgagaccaaaaatttgagacctgct

SEQ ID NO: 1185 - DNA, 226 bp, synthetic construct
  misc_feature 1..226: note = Synthetic polypeptide
  source 1..226: mol_type = other DNA
atggaggctgagctcacaccactggaatcagctatcaatgtgctggagatgattaaaacggaatttacactgacagaagcagtggtcgaatccagtagaaaactggtcaaggaagcttgaatatcagcaaatataacctacataaacagaaagctctttgagggtctgcagtaacgttttaagaagaatataaaagaatcctgagaccaaaaatttgagacctgct

SEQ ID NO: 1186 - DNA, 280 bp, synthetic construct
  misc_feature 1..280: note = Synthetic polypeptide
  source 1..280: mol_type = other DNA
atgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagcttgaatatcagcaaatataacctacataaacagaaagctctttgagggtctgcagtaacgttttaagaagaatataaaagaatcctgagaccaaaaatttgagacctgct

SEQ ID NO: 1187 - DNA, 712 bp, synthetic construct
  misc_feature 1..712: note = Synthetic polypeptide
  source 1..712: mol_type = other DNA
atggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgctataataatgaaggcag

SEQ ID NO: 1188 - DNA, 372 bp, synthetic construct
  misc_feature 1..372: note = Synthetic polypeptide
  source 1..372: mol_type = other DNA
atggaagatgcactctttctgcggaccctgcacttgatggatcagctggcaccaccgactaataaactggcttatctgatgttgtggcctccactcaggaactgactgaaggcaggaagacagcttcaactccctgtgatttcacccctgaccaatcaccacacctggctcactggctaccccccaactcccacccaccaagttatccttaaaaactctgctctccaaatgctcagggagactgatttgagtaataaaactccagtctcccacacagctggctctgcgtgaattactttattgcaactcccctgccttgatgaattggctctgtctaggcagcaggcaaggtgaaccccttgggtggttaca

SEQ ID NO: 1189 - DNA, 914 bp, synthetic construct
  misc_feature 1..914: note = Synthetic polypeptide
  source 1..914: mol_type = other DNA
ggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggcctgggcgacagagtgactccatctcaaaaaaaaaaaaaagaaa

SEQ ID NO: 1190 - DNA, 922 bp, synthetic construct
  misc_feature 1..922: note = Synthetic polypeptide
  source 1..922: mol_type = other DNA
atgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggcctgggcgacagagtgactccatctcaaaaaaaaaaaaaagaaa

SEQ ID NO: 1191 - DNA, 790 bp, synthetic construct
  misc_feature 1..790: note = Synthetic polypeptide
  source 1..790: mol_type = other DNA
atgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggcctgggcgacagagtgactccatctcaaaaaaaaaaaaaagaaa

SEQ ID NO: 1192 - DNA, 754 bp, synthetic construct
  misc_feature 1..754: note = Synthetic polypeptide
  source 1..754: mol_type = other DNA
atgcagagggctgtaagtgtggtggcccgtctgggctttcgcctgcaggcattccccccggccttgtgtcgtccacttagttgcgcacagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggcctgggcgacagagtgactccatctcaaaaaaaaaaaaaagaaa

SEQ ID NO: 1193 - DNA, 631 bp, synthetic construct
  misc_feature 1..631: note = Synthetic polypeptide
  source 1..631: mol_type = other DNA
atggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggcctgggcgacagagtgactccatctcaaaaaaaaaaaaaagaaa

SEQ ID NO: 1194 - DNA, 604 bp, synthetic construct
  misc_feature 1..604: note = Synthetic polypeptide
  source 1..604: mol_type = other DNA
atggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggacaacaacccggaggaatctccaaggaattaaacttagtgtaaaaaactcaatcccagaaaattacatg

SEQ ID NO: 1195 - DNA, 364 bp, synthetic construct
  misc_feature 1..364: note = Synthetic polypeptide
  source 1..364: mol_type = other DNA
atgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggacaacaacccggaggaatctccaaggaattaaacttagtgtaaaaaactcaatcccagaaaattacatg

SEQ ID NO: 1196 - DNA, 639 bp, synthetic construct
  misc_feature 1..639: note = Synthetic polypeptide
  source 1..639: mol_type = other DNA
gctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggaggccccaggtcccctggcaccggtcccaagcacagtttgtccactgaggaggaaactctggcagaattatcgcaatctgacctttgatccagtcagcgccaaccgtcacttctatctgtcgcgccaggaccagcaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaa

SEQ ID NO: 1197 - DNA, 500 bp, synthetic construct
  misc_feature 1..500: note = Synthetic polypeptide
  source 1..500: mol_type = other DNA
ccactgacccctctgcagtgggatgaagaccaacagctgggtgacctgaagcagttgctaagccggctgtgtggcctcctcttggaagaggggagccaccctggggcaccagccaagcctgtggacttagcccccgtggattatcgcaatctgacctttgatccagtcagcgccaaccgtcacttctatctgtcgcgccaggaccagcaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaa

SEQ ID NO: 1198 - DNA, 1346 bp, synthetic construct
  misc_feature 1..1346: note = Synthetic polypeptide
  source 1..1346: mol_type = other DNA
atggccgcgcagctgctggaggagaagctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggaggccccaggtcccctggcaccggtcccaagcacagtttgtccactgaggaggaaactctggcagaattatcgcaatctgacctttgatccagtcagcgccaaccgtcacttctatctgtcgcgccaggaccagcaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaa

SEQ ID NO: 1199 - DNA, 901 bp, synthetic construct
  misc_feature 1..901: note = Synthetic polypeptide
  source 1..901: mol_type = other DNA
gggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggattatcgcaatctgacctttgatccagtcagcgccaaccgtcacttctatctgtcgcgccaggaccagcaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaa

SEQ ID NO: 1200 - DNA, 1391 bp, synthetic construct
  misc_feature 1..1391: note = Synthetic polypeptide
  source 1..1391: mol_type = other DNA
atggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatcatccaccgggacctcaagtccatcaacatcctgatcctggaggccatcgagaaccacaacctcgcagacacggtgctcaagatcacggacttcggcctcgcccgcgagtggcacaagaccaccaagatgagcgctgcggggacctacgcctggatggcgccggaggttatccgtctctccctcttctccaaaagcagtgatgtctggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaagtacttacaggtgacactgcatgatgtctggggttggctttaaaatactacagcagaaacgaagagagggcaagaggagagaaggacggggatacaagattcgcaaagcataggtaattgttgaaattggatgatgggtacaggggggtgcactgttctctgcttttgtggatgtttgaagttttctaaattgaagagttaaga

SEQ ID NO: 1201 - DNA, 467 bp, synthetic construct
  misc_feature 1..467: note = Synthetic polypeptide
  source 1..467: mol_type = other DNA
caagatcacggacttcggcctcgcccgcgagtggcacaagaccaccaagatgagcgctgcggggacctacgcctggatggcgccggagaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaagtacttacaggtgacactgcatgatgtctggggttggctttaaaatactacagcagaaacgaagagagggcaagaggagagaaggacggggatacaagattcgcaaagcataggtaattgttgaaattggatgatgggtacaggggggtgcactgttctctgcttttgtggatgtttgaagttttctaaattgaagagttaaga

SEQ ID NO: 1202 - DNA, 641 bp, synthetic construct
  misc_feature 1..641: note = Synthetic polypeptide
  source 1..641: mol_type = other DNA
ctcgcccgcgagtggcacaagaccaccaagatgagcgctgcggggacctacgcctggatggcgccggaggttatccgtctctccctcttctccaaaagcagtgatgtctggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaagtacttacaggtgacactgcatgatgtctggggttggctttaaaatactacagcagaaacgaagagagggcaagaggagagaaggacggggatacaagattcgcaaagcataggtaattgttgaaattggatgatgggtacaggggggtgcactgttctctgcttttgtggatgtttgaagttttctaaattgaagagttaaga

SEQ ID NO: 1203 - DNA, 824 bp, synthetic construct
  misc_feature 1..824: note = Synthetic polypeptide
  source 1..824: mol_type = other DNA
atgatcgattcaggagaaaagaagcctgggcggagagcagaggaggcagtgaccttcaaggatgtggctgtgatcttcactgaggaggagctggggctgctggaccctgcccagaggaagctgtaccgagatgtgatgcttgagaacttcaggaacctgctctcagtggggcatcaaccattccatggagatactttccacttcctaagggaagaaaagttttgggtgatggggacaacaagccaaagagaagggaatttgggcacaattctgctttccctggaactgtgtcattcaggactctgcaaattccctaaagtaggaggaaaaatgaccatgtccaaggaggcagtgaccttcaaggatgtggcagtggtcttcactgaggaggagctggggctgctggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagggaagggaattcagtttatgcaggtgtctgctgagttttaatgtcatggaagaggtcatcttcaagcaccctattgaaaataccatcctatctttacttggcctgcaagtattatgtgtcatatgcttttgtttactgatagatcacctgttccctttcaaatataatctctacaaggtgtttatctgtttgtttatgactgcatcttcagtgcctagaatagtcctagtacatggagggatctgtaaatatttggtatcctgatgaatgaat

SEQ ID NO: 1204 - DNA, 494 bp, synthetic construct
  misc_feature 1..494: note = Synthetic polypeptide
  source 1..494: mol_type = other DNA
atgaccatgtccaaggaggcagtgaccttcaaggatgtggcagtggtcttcactgaggaggagctggggctgctggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagggaagggaattcagtttatgcaggtgtctgctgagttttaatgtcatggaagaggtcatcttcaagcaccctattgaaaataccatcctatctttacttggcctgcaagtattatgtgtcatatgcttttgtttactgatagatcacctgttccctttcaaatataatctctacaaggtgtttatctgtttgtttatgactgcatcttcagtgcctagaatagtcctagtacatggagggatctgtaaatatttggtatcctgatgaatgaat

SEQ ID NO: 1205 - DNA, 386 bp, synthetic construct
  misc_feature 1..386: note = Synthetic polypeptide
  source 1..386: mol_type = other DNA
atgctggagaacttcaggaacctgctgtcagtggggcatcaaccattccaccgagatactttccactttctaagggaggaaaagttttggatgatggatatagcaacccaaagggaagggaattcagtttatgcaggtgtctgctgagttttaatgtcatggaagaggtcatcttcaagcaccctattgaaaataccatcctatctttacttggcctgcaagtattatgtgtcatatgcttttgtttactgatagatcacctgttccctttcaaatataatctctacaaggtgtttatctgtttgtttatgactgcatcttcagtgcctagaatagtcctagtacatggagggatctgtaaatatttggtatcctgatgaatgaat

SEQ ID NO: 1206 - DNA, 1206 bp, synthetic construct; identical to SEQ ID NO: 282
  misc_feature 1..1206: note = Synthetic polypeptide
  source 1..1206: mol_type = other DNA

SEQ ID NO: 1207 - DNA, 1209 bp, synthetic construct; identical to SEQ ID NO: 281
  misc_feature 1..1209: note = Synthetic polypeptide
  source 1..1209: mol_type = other DNA

SEQ ID NO: 1208 - DNA, 1203 bp, synthetic construct; identical to SEQ ID NO: 286
  misc_feature 1..1203: note = Synthetic polypeptide
  source 1..1203: mol_type = other DNA

SEQ ID NO: 1209 - DNA, 925 bp, synthetic construct
  misc_feature 1..925: note = Synthetic polypeptide
  source 1..925: mol_type = other DNA
atgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagaatggggcta

SEQ ID NO: 1210 - DNA, 736 bp, synthetic construct
  misc_feature 1..736: note = Synthetic polypeptide
  source 1..736: mol_type = other DNA
atggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagaatggggcta

SEQ ID NO: 1211 - DNA, 755 bp, synthetic construct
  misc_feature 1..755: note = Synthetic polypeptide
  source 1..755: mol_type = other DNA
gcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagaatggggcta

SEQ ID NO: 1212 - DNA, 424 bp, synthetic construct
  misc_feature 1..424: note = Synthetic polypeptide
  source 1..424: mol_type = other DNA
atggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagaatggggcta

SEQ ID NO: 1213 - DNA, 2033 bp, synthetic construct
  misc_feature 1..2033: note = Synthetic polypeptide
  source 1..2033: mol_type = other DNA
atggaaaatcaattggctaaatcaactgaagaacgaacatttcagtaccaggattctcttccatcactgcctgttccttcacttgaagaatcattaaaaaaataccttgaatcagtcaccagaacatgctaccagataaggggtcttgatccagatgctaagagagggttcttggatctcacgcgggaaggaattcaagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacagagaacatcatgaaagtctggaaggattacaccattgaagatgccattgttgttaagaagaagtcatgaaagcagtcaagcccaaaacaataaatttctactagagaaaactatgtccagatgtacatgatttcacaggatttacgacagagccagtctaggaaatcatgaaagagattgtcgatatggcaaaaaaaagtggagggtgaaggatttcaaggtatggatgttg

SEQ ID NO: 1214 - DNA, 1949 bp, synthetic construct
  misc_feature 1..1949: note = Synthetic polypeptide
  source 1..1949: mol_type = other DNA
atggaaaatcaattggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacagagaacatcatgaaagtctggaaggattacaccattgaagatgccattgttgttaagaagaagtcatgaaagcagtcaagcccaaaacaataaatttctactagagaaaactatgtccagatgtacatgatttcacaggatttacgacagagccagtctaggaaatcatgaaagagattgtcgatatggcaaaaaaaagtggagggtgaaggatttcaaggtatggatgttg

SEQ ID NO: 1215 - DNA, 55 bp, synthetic construct; identical to SEQ ID NO: 291
  misc_feature 1..55: note = Synthetic polypeptide
  source 1..55: mol_type = other DNA

SEQ ID NO: 1216 - DNA, 25 bp, synthetic construct
  misc_feature 1..25: note = Synthetic polypeptide
  source 1..25: mol_type = other DNA
atgagcgtcctttcgtttttttaaa

SEQ ID NO: 1217 - DNA, 325 bp, synthetic construct
  misc_feature 1..325: note = Synthetic polypeptide
  source 1..325: mol_type = other DNA
atgaagaagtcttactcaggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatggtgagttgtataattatctcattatatattataataataatagaaataaagtgcacaatcaatacaacgtgcttgtggccgggtgcagtggctcacacctgtaatcccagagtgaaactctgtctcaaaaaataaaaaataaa

SEQ ID NO: 1218 - DNA, 537 bp, synthetic construct
  misc_feature 1..537: note = Synthetic polypeptide
  source 1..537: mol_type = other DNA
atgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatcagcatgaaaatggactaataca

SEQ ID NO: 1219 - DNA, 375 bp, synthetic construct
  misc_feature 1..375: note = Synthetic polypeptide
  source 1..375: mol_type = other DNA
atgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatcagcatgaaaatggactaataca

SEQ ID NO: 1220 - DNA, 363 bp, synthetic construct
  misc_feature 1..363: note = Synthetic polypeptide
  source 1..363: mol_type = other DNA
atgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatcagcatgaaaatggactaataca

SEQ ID NO: 1221 - DNA, 1068 bp, synthetic construct
  misc_feature 1..1068: note = Synthetic polypeptide
  source 1..1068: mol_type = other DNA
atgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaagaaacagtggaaccagtcctgagcatctaac

SEQ ID NO: 1222 - DNA, 1156 bp, synthetic construct
  misc_feature 1..1156: note = Synthetic polypeptide
  source 1..1156: mol_type = other DNA
atgtattttctgagcggctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaagcaggtttgagggatccttcctggagaaatggaaccactgaagaaaaactgctcaacaggtactagtatttgaagacctcaaaaaagtgctggctggccactaccctgctgaagtccaccagttgacagcctgcagacacgtagtcacctttttattgttaacctctaaaataagaacaaaggactaaacattgttagccattttaggaaagtttccagtgtaacttagaaacacataccagaaaaaaggaacttaaagtaaacagatacttgaaggaatgaaaacagtttgaggaaataattaacaaccttagacagattttggctaatcaaacaaggtaggatggtttaagaaaacggggggagtggatgagaaaattctcagaatgaaaagtacaatagtagaaatatattcagtaaaagcattgaaagaaacagttgaggaactttccctggatatagaataaaagacaagaataagagagaaaagagaaaattagagtttaatatgaggtttaatatctaactgactaggagttgtagaaagagagaacagggaatggagaagcttattattatattaaggaaacaaaacatgtaaatttcctagagtttaaactaaatacatcagtagattgaacaggtctaccaggtgctcagtgcaatgataaacattcacatacttgtagaaaaattaattattttgaaatttcagaacccatcggatatataaaaagaagatcctaggtacttcagaggaaaaagagctagtctgtgaataggaatgtcattgaactccacagccacacttgagaatctaaaag

SEQ ID NO: 1223 - DNA, 919 bp, synthetic construct
  misc_feature 1..919: note = Synthetic polypeptide
  source 1..919: mol_type = other DNA
atgatagctgtatcaacggcaaatggatacatcttgttttttcatattacatctacaagaggggacaagtacctttatgaaccagtgtatcccaagcaggtttgagggatccttcctggagaaatggaaccactgaagaaaaactgctcaacaggtactagtatttgaagacctcaaaaaagtgctggctggccactaccctgctgaagtccaccagttgacagcctgcagacacgtagtcacctttttattgttaacctctaaaataagaacaaaggactaaacattgttagccattttaggaaagtttccagtgtaacttagaaacacataccagaaaaaaggaacttaaagtaaacagatacttgaaggaatgaaaacagtttgaggaaataattaacaaccttagacagattttggctaatcaaacaaggtaggatggtttaagaaaacggggggagtggatgagaaaattctcagaatgaaaagtacaatagtagaaatatattcagtaaaagcattgaaagaaacagttgaggaactttccctggatatagaataaaagacaagaataagagagaaaagagaaaattagagtttaatatgaggtttaatatctaactgactaggagttgtagaaagagagaacagggaatggagaagcttattattatattaaggaaacaaaacatgtaaatttcctagagtttaaactaaatacatcagtagattgaacaggtctaccaggtgctcagtgcaatgataaacattcacatacttgtagaaaaattaattattttgaaatttcagaacccatcggatatataaaaagaagatcctaggtacttcagaggaaaaagagctagtctgtgaataggaatgtcattgaactccacagccacacttgagaatctaaaag

SEQ ID NO: 1224 - DNA, 941 bp, synthetic construct
  misc_feature 1..941: note = Synthetic polypeptide
  source 1..941: mol_type = other DNA
tgaatggaggccagatagtaccatgatagctgtatcaacggcaaatggatacatcttgttttttcatattacatctacaagaggggacaagtacctttatgaaccagtgtatcccaagcaggtttgagggatccttcctggagaaatggaaccactgaagaaaaactgctcaacaggtactagtatttgaagacctcaaaaaagtgctggctggccactaccctgctgaagtccaccagttgacagcctgcagacacgtagtcacctttttattgttaacctctaaaataagaacaaaggactaaacattgttagccattttaggaaagtttccagtgtaacttagaaacacataccagaaaaaaggaacttaaagtaaacagatacttgaaggaatgaaaacagtttgaggaaataattaacaaccttagacagattttggctaatcaaacaaggtaggatggtttaagaaaacggggggagtggatgagaaaattctcagaatgaaaagtacaatagtagaaatatattcagtaaaagcattgaaagaaacagttgaggaactttccctggatatagaataaaagacaagaataagagagaaaagagaaaattagagtttaatatgaggtttaatatctaactgactaggagttgtagaaagagagaacagggaatggagaagcttattattatattaaggaaacaaaacatgtaaatttcctagagtttaaactaaatacatcagtagattgaacaggtctaccaggtgctcagtgcaatgataaacattcacatacttgtagaaaaattaattattttgaaatttcagaacccatcggatatataaaaagaagatcctaggtacttcagaggaaaaagagctagtctgtgaataggaatgtcattgaactccacagccacacttgagaatctaaaag

SEQ ID NO: 1225 - DNA, 128 bp, synthetic construct; identical to SEQ ID NO: 144
  misc_feature 1..128: note = Synthetic polypeptide
  source 1..128: mol_type = other DNA

SEQ ID NO: 1226 - DNA, 916 bp, synthetic construct
  misc_feature 1..916: note = Synthetic polypeptide
  source 1..916: mol_type = other DNA
atgcagagcctttccttaggacaaacaaggcccataaaagccctggattcagccagacgaggatacaatgggacggctagctgcggagagaagctacctgctcaagagtctcccttttgctgagagctgagtagatgacgaaacaacctgtgtggagagaggagctcctcactccagggtctcctctctgctcagagctgaacactcactgggacaccctggctgtggagaggagctaccctctgtgggtctcctctgagctgttctgtcacccaataaaactcctcttcaccttgctcaccctccacttgtctgtgtacctcattcttcctagatgcaggacaagaacttgggactcactgaatggtggggctaaaagagctgtaacacaaatagggctgaaatacaccccttgcttgccatgttgtgggtaagaagaaggaaagaagaatgaagagctgcagcccttcagggagcccagacctaggagctatctgcaccatgactgtgacaccctctttagggctctgcggtttctggtgtctccaagcttctaggtgccaccgtgtttcccagtgccagccatggaagctgcttgcagtacacctggtccagctgcaggcttgcagggagccagcgcctgtgccagtgcctggagctgcatgtcccgcagtcgccagtgtgcctggctgtgcgcagtagttagaccccacgctcactcatacacccctcactgctctgtgccttgcttgcccttggcaggcatgggatccaggccagaagcatgagctgactgcagtctggcaggtcaagtgggtggaatgagcccagcaggcctgagcaaaacttgggcaaaggcgtcactggccacagatgtttctggctggtgaagtgacacccgaagaatcctgtgaca

SEQ ID NO: 1227 - DNA, 572 bp, synthetic construct; identical to SEQ ID NO: 159
  misc_feature 1..572: note = Synthetic polypeptide
  source 1..572: mol_type = other DNA

SEQ ID NO: 1228 - DNA, 3378 bp, synthetic construct
  misc_feature 1..3378: note = Synthetic polypeptide
  source 1..3378: mol_type = other DNA
atggagcggcggctgcgcgcgctggagcagctggcgcggggcgaggccggcggctgcccggggctcgacggcctcctagatctgctgctggcgctgcaccacgagctcagcagcggccccctacggcgggagcgcagcgtggcgcagttcctgagctgggccagccccttcgtatcaaaggtgaaagaactgcgtctgcagagagatgactttgagatcttgaaggtgatcggccgaggagcctttggggaggtcaccgtggtgaggcagagggacactgggcagatttttgccatgaaaatgctgcacaagtgggagatgctgaagagggctgagacagcctgtttccgggaggagcgggatgtgctcgtgaaaggggacagccgttgggtgaccactctgcactatgccttccaagacgaggagtacctgtaccttgtgatggactactatgctggtggggacctcctgacgctgctgagccgcttcgaggaccgtctcccgcccgagctggcccagttctacctggctgagatggtgctggccatccactcgctgcaccagctgggttatgtccacagggatgtcaagccagacaacgtcctgctggatgtgaacgggcacattcgcctggctgacttcggctcctgcctgcgtctcaacaccaacggcatggtggattcatcagtggcagtagggacgccggactatatctcccctgagatcctgcaggccatggaggagggcaagggccactacggcccacagtgtgactggtggtcgcttggagtctgcgcctatgagctgctctttggggagacgcccttctatgctgagtccttggtggaaacctacggcaagatcatgaaccacgaggaccacctgcagttccccccggacgtgcctgacgtgccagccagcgcccaagacctgatccgccagctgctgtgtcgccaggaagagcggctaggccgtggtgggctggatgacttccggaaccatcctttcttcgaaggcgtggactgggagcggctggcgagcagcacggccccctatattcctgagctgcgggggcccatggacacctccaactttgatgtggatgacgacaccctcaaccatccagggaccctgccaccgccctcccacggggccttctccggccatcacctgccattcgtgggcttcacctacacctcaggcagtcacagtcctgagagcagctctgaggcttgggctgccctggagcggaagctccagtgtctggagcaggagaaggtggagctgagcaggaagcaccaagaggccctgcacgcccccacagaccatcgggagctggagcagctacggaaggaagtgcagactctgcgggacaggctgccagagatgctgagggacaaggcctcattgtcccagacggatgggcccccagctggtagcccaggtcaggacagtgacctacggcaggagcttgaccgacttcaccgggagctggccgagggtcgggcagggctgcaggctcaggagcaggagctctgcagggcccaggggcagcaggaggagctgcttcagaggctacaggaggcccaggagagagaggcggccacagctagccagacccgggccctgagctcccagctggaggaagcccgggctgcccagagggagctggaggcccaggtgtcctccctgagccggcaggtgacgcagctgcagggacagtgggagcaacgccttgaggagtcgtcccaggccaagaccatccacacagcctctgagaccaacgggatgggaccccctgagggtgggcctcaggaggcccaactgaggaaggaggtggccgccctgcgagagcagctggagcaggcccacagccacaggccgagtggtaaggaggaggctctgtgccagctgcaggaggaaaaccggaggctgagccgggagcaggagcggctagaagcagagctggcccaggagcaggagagcaagcagcggctggagggtgagcggcgggagacggagagcaactgggaggcccagctcgccgacatcctcagctgggtgaatgatgagaaggtctcaagaggctacctgcaggccctggccaccaagatggcagaggagctggagtccttgaggaacgtaggcacccagacgctccctgcccggccactggaccaccagtggaaggcgcggcgactgcagaagatggaggcctcggccaggctggagctgcagtcagcgctggaggccgagatccgcgccaagcagggcctgcaggagcggctgacacaggtgcaggaggcccagctgcaggctgagcgccgtctgcaggaggccgagaagcagagccaggccctgcaacaggagctcgccatgctgcgggaggagctgcgggcccgagggccagtggacaccaagccctcaaactccctgattcccttcctgtccttccggagctcagagaaggattctgccaaggaccctggcatctcaggagaggccacaaggcatggaggagagccagatctgaggccggagggccgacgcagcctgcgcatgggggctgtgttccccagagcacccactgccaacacagcctctacagaaggtcttcctgctaagcccggctcacacacgctgcgcccccggagcttcccatccccgaccaagtgtctccgctgcacctcgctgatgctgggcctgggccgccagggcctgggttgtgatgcctgcggctacttttgtcacacaacctgtgccccacaggccccaccctgccccgtgccccctgacctcctccgcacagccctgggagtacaccccgaaacaggcacaggcactgcctatgagggctttctgtcggtgccgcggccctcaggtgtccggcggggctggcagcgcgtgtttgctgccctgagtgactcacgcctgctgctgtttgacgcccctgacctgaggctcagcccgcccagtggggccctcctgcaggtcctagatctgagggacccccagttctcggctacccctgtcctggcctctgatgttatccatgcccaatccagggacctgccacgcatctttaggttctgaaggcgccctgtgcctgtgtgcaccacattctcagtccttcacatctgtctttgcacgaaattgccggccctgcactggagcccagcccctcacctaccttgactactcctggttagttactcgtccctcaggcttcagcagaaatgtctggtctcctgggaagtcatccttcacttcccggccccggtttgggtccctctgtgttcccactaggcccgtccttgccccattatggcgctggtcgcatggctctggagttgtctgtttgcctgtctggcctactcc

SEQ ID NO: 1229 - DNA, 1034 bp, synthetic construct
  misc_feature 1..1034: note = Synthetic polypeptide
  source 1..1034: mol_type = other DNA
atggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagctacttgggaggctgaagcaggagaatcgcttgaacccgggagatggaggttgcagtgagccaagatcacaccattgcactccagcatggacaacagagtgagattccgtctcaaaaaaaaaaaaaaaaagtaaaataaaaaa

SEQ ID NO: 1230 - DNA, 616 bp, synthetic construct
  misc_feature 1..616: note = Synthetic polypeptide
  source 1..616: mol_type = other DNA
ctcgtccaccccacagaggaaacgcccaccacccacgccccgggcttgtcctcatcttcagcgcgggtggccaccctcctgccccagcgccaggccccagccggcagcatgctgaggacttcctgggagaggtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagctacttgggaggctgaagcaggagaatcgcttgaacccgggagatggaggttgcagtgagccaagatcacaccattgcactccagcatggacaacagagtgagattccgtctcaaaaaaaaaaaaaaaaagtaaaataaaaaa

SEQ ID NO: 1231 - DNA, 1916 bp, synthetic construct
  misc_feature 1..1916: note = Synthetic polypeptide
  source 1..1916: mol_type = other DNA
atgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagtacctaacacagtgtctggcacatggatgggacttaagaactatcgaatgactgagtgaat

SEQ ID NO: 1232 - DNA, 1125 bp, synthetic construct
  misc_feature 1..1125: note = Synthetic polypeptide
  source 1..1125: mol_type = other DNA
atgtcctctggagccccacagaagagcagcccaatggccagtggagctgaggagaccccaggcttcctggacacgctcctgcaagacttcccagccctgctgaacccagaggaccctctgccatggaaggccccagggacggtgctcagccaggaggaggtggagggcgagctggctgagctggccatgggctttctgggcagcaggaaggccccgccaccacttgctgctgctctggcccacgaagcagtttcacagctgctacagacagacctttccgaattcaggaagttgcccagggaggaagaagaagaggaggaggacgatgacgaggaggaaaaggcccctgtgaccttgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcgctattcagaaggctgaggcaggagaatcacttgaacccagaaggcggaggttgcagtgagctgagatcgcgccactccactccagcctggataacgaggaaaactctgtctcaaaaaataataataaaaataaataaaaa

SEQ ID NO: 1233 - DNA, 621 bp, synthetic construct
  misc_feature 1..621: note = Synthetic polypeptide
  source 1..621: mol_type = other DNA
atggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcgctattcagaaggctgaggcaggagaatcacttgaacccagaaggcggaggttgcagtgagctgagatcgcgccactccactccagcctggataacgaggaaaactctgtctcaaaaaataataataaaaataaataaaaa

SEQ ID NO: 1234 - DNA, 813 bp, synthetic construct
  misc_feature 1..813: note = Synthetic polypeptide
  source 1..813: mol_type = other DNA
atgggtctctgtccgtccacgcgggagacagcgccacctgccgtgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcgctattcagaaggctgaggcaggagaatcacttgaacccagaaggcggaggttgcagtgagctgagatcgcgccactccactccagcctggataacgaggaaaactctgtctcaaaaaataataataaaaataaataaaaa

SEQ ID NO: 1235 - DNA, 1425 bp, synthetic construct
  misc_feature 1..1425: note = Synthetic polypeptide
  source 1..1425: mol_type = other DNA
atgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagggactggcctgtctgtccactgctgtaaccccgcgccggcatagggacctaaggcccactggagggcgctcatcaagtagctgctggatg

SEQ ID NO: 1236 - DNA, 1479 bp, synthetic construct
  misc_feature 1..1479: note = Synthetic polypeptide
  source 1..1479: mol_type = other DNA
atgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtagagatggggtttcaccatgttggccaggctgctctcgaactcctgacctcagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagggactggcctgtctgtccactgctgtaaccccgcgccggcatagggacctaaggcccactggagggcgctcatcaagtagctgctggatg

SEQ ID NO: 1237 - DNA, 1164 bp, synthetic construct
  misc_feature 1..1164: note = Synthetic polypeptide
  source 1..1164: mol_type = other DNA
atgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagggactggcctgtctgtccactgctgtaaccccgcgccggcatagggacctaaggcccactggagggcgctcatcaagtagctgctggatg

SEQ ID NO: 1238 - DNA, 1231 bp, synthetic construct
  misc_feature 1..1231: note = Synthetic polypeptide
  source 1..1231: mol_type = other DNA
atgacggctccttgctcccagccggcgcagcttcctggacgccgccagctcgggctggtgccgttcccgccgccgccgccgcggacgccgctgctgtggctgctgctgctgctgctggccgccgtggcgccggcgcgcggctgggagagcggagacctggagttgtttgacttagtggaggaggtgcagctcaacttctaccagttcctcggggtgcagcaggatgcatcatctgcagacatcagaaaagcatatcgtaagctttcactaactttacatccagacaagaataaagatgaaaatgcagaaactcagtttagacaattggtggccatttatgaagttttaaaggatgatgaacgaaggcagaggtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggatgaactactaagtagaaaaaagagagaaaagaaaaaaaagactggcagcaagagtgtggatgtatcaaaactcggtgcttcagaaaaaaatgaaagattgctgatgaaaccacagtggcatgatttgcttccatgcaaactggggatttggttttgccttacactaaaagcattacctcacctcatccaggatgctgggcagttttatgctaaatataaagaaacaagattgaaggaaaaggaagatgcactgactagaactgaacttgaaacacttcaaaaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggaaattgtcacagacaccccaacctttaccaaccaccaccccagtgagtcagcagccactaacatgaatgcaagaccctctaccaatagaaagattatgacttgttgaaagactcagatggttattaatacgttttagcggtaaagtatttttaaattatgtacattgttttttggacataatgctatcacacacttaataaactaagctacaatgtaaacttagttttaaacatttttttaaattattatta

SEQ ID NO: 1239 - DNA, 6375 bp, synthetic construct
  misc_feature 1..6375: note = Synthetic polypeptide
  source 1..6375: mol_type = other DNA
atgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctgtcttgacaactggaagaccaggagataccctcccttgcctggctcagtgggtcacacgcccatggagacttgctcactgctagcgcagcagtctgagatcaacctgcaatgctgctgcttgatgcggggaggggcgtctgccattgatgaagcttgagtagctcacagcgtaaacaaagcagcagggaagcttgaactgggcagagcccacctcagctcagcaaggcctactgcctctctagattccacctctgggggcagcacatagcagaacaaaaggcagcagacagcttccgcagacttaaacatccctgtctgacacctctgaagagggcagtggttctctcagcacagtgttcaagctccaagaaccaagagaccgccacctcaagcaggtccctgacccccatgtagcctgactgggagacacctcccagtaggggccgacagacacttcaaacaggcaggtgccctctgggacgaagcttccagaggaaggatcaggcagcaatatttgttgttctgcagcctccgctggtgatacccaggcaaacagggtctggggtggacctccagcaaactccaacaggcctgcagctgaggggcctgacggttagaaggaaaactaacaaacagaaaggaatagcatcaacatcaacaaaaaggacatccacaccaaaaccccatctgtaggtcatcaacatcaaagaccaaaggtagataaaaccacaaagatggggagaaaccagagcagaaaagtggaaaattccaaaaaccagagcgcctcttctgctccaaaggattgcagctcctcaccagcaagggaacaaaacaggatggagaatgagtttgatgagttgacagaagtaggcttcagaaggtcggtaataacaaacttctccaagctaaaggaacatgttctaacccatcgcaaggaggctaaaaaccttgaaaaaaggttagatgaatggctaactagaataaacagtgtagagaagaacttaaatgacctgatggagctgaaaaccacagcatgagaacttcgtgatgtatgcacaagcttcgatagctgatttgatcaagtggaagaaaggatatcagtgattgaagatcaaattaatgaaataaagtgagaagacaagatgagagaaaagaagagtgaaaagaaacgaacaaagcctccaagaaatatgggactatgtgaaacaaacaaatatatgtttcattggtgtactgggaagtgatggggagaatggaaccaagttagaaaacactcttcaggatattatccaggacaacttccccaacctagcaaggcaggccaacattcaaattcaggaaatacagagaacactacaaagatactcctcaagaagagcaaccccaagacacataattttcagatttaaaaagtatgaaatgaaggaaaaaatgttaagggcagccagagagaaaagtcgggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggagacccatctcacgtgcaaaaatgcacataggctcaaaataaagggtcgaaggaaaatctactgagcaaatggaaagaaaaaaaaaagcaggggttgcaatcccagtctctgataaaacagaatttaaaccaacaaagatcaaaagagacaaagacagccacaacaagaagagctaactaccctaaatatatatgcacccagtacaggagcacccagattcataaagcaagtccttagagacctacgaagagacatagactcccacacaataataatgggagactgggagacaccccacagtcaatattaaacagatcaacaagacagaaggttaacaaggatatccaggacttgaactcagctctagaccaagtggacccaatagacatctacagaactctccacccctaatcaacagaatatacattcttctcagcaccacattgcacttattttaaaattgaccacataattggaagtaaaacactcctcagcaaatgtaaaagaacagaagtcacaacaaactgtctctcagaccacagtgcaatcaaattagaactcaggattaagaaactgactcaaatccacacagctacgtggaaactgaacaacctgctcctgaatgactactgggtaaataacaaaatgaaggcagaaataaagatgttctttgaaaccaatgagaacaaggacacaatgtaccagaatttctgggacacatttaaagcagtgtgtagagggaaatttatagcactaaatgcccacgagagaaagcaggaaagatctaaaatcgacaccctaacatcacaattgaaagaactagagaagcaagagcaaacaaattcaaaagcaagcagaaggcaagaaataactgagatcagagcagaactgaaggagacagagacacaaaaagccgttcaaaaaatcaatgaatccaggagctggttttttgaaaagatcaacaaaattgatagaccactagcaagactaataaagaagaaaagagagaagaatcgaatagatgcaataaaaaatgataaagggatatcaccaccgatcccacagaaatacaaactaccatcagagaatactataaactcctctacgcaaataaactggaaaatctagaagaaatggataaattcctggacacatacaccctcccaagactcaaccaggaagaagttgaatctctgaagacaccaataacaggtactgaaccaaggtttggaccaaccaaaaatgtccaggaccagatggattcacagttgaattctaccagaggtacaaagaggagctggtaccattccttcagaaactattccaatcaatagaaaaagagggactcctccctaactcattttatgaggccagcatcatcctggtaccaaaacctggcagagacacaacaaaaaaagagaattttaggctaatatccctgatgaacatcgatgtgaaaatcctcaataaaatactggcaaaccaaatccagcagcacatcaaaaagcctatccaccaaaaccaagtcagcttcattcctgggatgcaagactggttcaacatacgcaaataaataaatgtaatccatcacataaacagaaccaatgacaaaaaccacatgattatctcaatagatgcagaaaaggcctttgacaaaattcaacagcctttcttgctaaaaactctaaataaattaggtattgatggaacgtacctcaaaataataagagctatttatgacaaacccacagccaatatcatactgaatgggcaaaacctggaagcattccttttgaaaaccagcacaagataagaatgccctctctcaccactcctattcaacatagtgttggaagttctggctagggcaatcaggcaagagaaagaaataaagggtattcagttaggaaaagaggaagtcaaattgtctctgtttgcagatgacacgattgtatatttagaaaaccccattgtctcagcccaaaatctccttaagctgataagcaacttcagcaaagtctcaggatacaaaatcaatgtgcaaaaatcacaggcattcctgtacaccaataatagacaaacagagagccaaatcatgagtgaactcccattcagaattactacaaagagaataaaatacctaggaatccaacttacaagggatgtgaaggacctcttcaaggagaactacaaaccactgctcaacgaaataaaagaggacacaaacaaatggaagaacattccatgctcgtggataggaataatcaatatcacgaaaatggtcatactgcccaaggtaatttatagattcagtgctatccccatcaagctaccattgactttcttcacagacttggaaaaaaactactttaaagctcacatggaaccaaaaaagagcctgcatagccaagacaatcctaagcaaaaagaacaaagctggaggcatcacgctacctgacttcaaaccatactacaaggctacagtaactaaaacagcatggtactggtaccaaaatagatatatagactaatggaacagaacagaggcctcagaaatgacaccacacatctgcaaccatctgatctttgacaaacctgacaaaaacaagaaatggggaaaggattccctatttaataaatggtgctaggaaaactggctagccatatgtagaaagctgaaactggatcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagttggcaaagg

SEQ ID NO: 1240 - DNA, 6039 bp, synthetic construct
  misc_feature 1..6039: note = Synthetic polypeptide
  source 1..6039: mol_type = other DNA
atgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctgtcttgacaactggaagaccaggagataccctcccttgcctggctcagtgggtcacacgcccatggagacttgctcactgctagcgcagcagtctgagatcaacctgcaatgctgctgcttgatgcggggaggggcgtctgccattgatgaagcttgagtagctcacagcgtaaacaaagcagcagggaagcttgaactgggcagagcccacctcagctcagcaaggcctactgcctctctagattccacctctgggggcagcacatagcagaacaaaaggcagcagacagcttccgcagacttaaacatccctgtctgacacctctgaagagggcagtggttctctcagcacagtgttcaagctccaagaaccaagagaccgccacctcaagcaggtccctgacccccatgtagcctgactgggagacacctcccagtaggggccgacagacacttcaaacaggcaggtgccctctgggacgaagcttccagaggaaggatcaggcagcaatatttgttgttctgcagcctccgctggtgatacccaggcaaacagggtctggggtggacctccagcaaactccaacaggcctgcagctgaggggcctgacggttagaaggaaaactaacaaacagaaaggaatagcatcaacatcaacaaaaaggacatccacaccaaaaccccatctgtaggtcatcaacatcaaagaccaaaggtagataaaaccacaaagatggggagaaaccagagcagaaaagtggaaaattccaaaaaccagagcgcctcttctgctccaaaggattgcagctcctcaccagcaagggaacaaaacaggatggagaatgagtttgatgagttgacagaagtaggcttcagaaggtcggtaataacaaacttctccaagctaaaggaacatgttctaacccatcgcaaggaggctaaaaaccttgaaaaaaggttagatgaatggctaactagaataaacagtgtagagaagaacttaaatgacctgatggagctgaaaaccacagcatgagaacttcgtgatgtatgcacaagcttcgatagctgatttgatcaagtggaagaaaggatatcagtgattgaagatcaaattaatgaaataaagtgagaagacaagatgagagaaaagaagagtgaaaagaaacgaacaaagcctccaagaaatatgggactatgtgaaacaaacaaatatatgtttcattggtgtactgggaagtgatggggagaatggaaccaagttagaaaacactcttcaggatattatccaggacaacttccccaacctagcaaggcaggccaacattcaaattcaggaaatacagagaacactacaaagatactcctcaagaagagcaaccccaagacacataattttcagatttaaaaagtatgaaatgaaggaaaaaatgttaagggcagccagagagaaaagtcgggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggagacccatctcacgtgcaaaaatgcacataggctcaaaataaagggtcgaaggaaaatctactgagcaaatggaaagaaaaaaaaaagcaggggttgcaatcccagtctctgataaaacagaatttaaaccaacaaagatcaaaagagacaaagacagccacaacaagaagagctaactaccctaaatatatatgcacccagtacaggagcacccagattcataaagcaagtccttagagacctacgaagagacatagactcccacacaataataatgggagactgggagacaccccacagtcaatattaaacagatcaacaagacagaaggttaacaaggatatccaggacttgaactcagctctagaccaagtggacccaatagacatctacagaactctccacccctaatcaacagaatatacattcttctcagcaccacattgcacttattttaaaattgaccacataattggaagtaaaacactcctcagcaaatgtaaaagaacagaagtcacaacaaactgtctctcagaccacagtgcaatcaaattagaactcaggattaagaaactgactcaaatccacacagctacgtggaaactgaacaacctgctcctgaatgactactgggtaaataacaaaatgaaggcagaaataaagatgttctttgaaaccaatgagaacaaggacacaatgtaccagaatttctgggacacatttaaagcagtgtgtagagggaaatttatagcactaaatgcccacgagagaaagcaggaaagatctaaaatcgacaccctaacatcacaattgaaagaactagagaagcaagagcaaacaaattcaaaagcaagcagaaggcaagaaataactgagatcagagcagaactgaaggagacagagacacaaaaagccgttcaaaaaatcaatgaatccaggagctggttttttgaaaagatcaacaaaattgatagaccactagcaagactaataaagaagaaaagagagaagaatcgaatagatgcaataaaaaatgataaagggatatcaccaccgatcccacagaaatacaaactaccatcagagaatactataaactcctctacgcaaataaactggaaaatctagaagaaatggataaattcctggacacatacaccctcccaagactcaaccaggaagaagttgaatctctgaagacaccaataacaggtactgaaccaaggtttggaccaaccaaaaatgtccaggaccagatggattcacagttgaattctaccagaggtacaaagaggagctggtaccattccttcagaaactattccaatcaatagaaaaagagggactcctccctaactcattttatgaggccagcatcatcctggtaccaaaacctggcagagacacaacaaaaaaagagaattttaggctaatatccctgatgaacatcgatgtgaaaatcctcaataaaatactggcaaaccaaatccagcagcacatcaaaaagcctatccaccaaaaccaagtcagcttcattcctgggatgcaagactggttcaacatacgcaaataaataaatgtaatccatcacataaacagaaccaatgacaaaaaccacatgattatctcaatagatgcagaaaaggcctttgacaaaattcaacagcctttcttgctaaaaactctaaataaattaggtattgatggaacgtacctcaaaataataagagctatttatgacaaacccacagccaatatcatactgaatgggcaaaacctggaagcattccttttgaaaaccagcacaagataagaatgccctctctcaccactcctattcaacatagtgttggaagttctggctagggcaatcaggcaagagaaagaaataaagggtattcagttaggaaaagaggaagtcaaattgtctctgtttgcagatgacacgattgtatatttagaaaaccccattgtctcagcccaaaatctccttaagctgataagcaacttcagcaaagtctcaggatacaaaatcaatgtgcaaaaatcacaggcattcctgtacaccaataatagacaaacagagagccaaatcatgagtgaactcccattcagaattactacaaagagaataaaatacctaggaatccaacttacaagggatgtgaaggacctcttcaaggagaactacaaaccactgctcaacgaaataaaagaggacacaaacaaatggaagaacattccatgctcgtggataggaataatcaatatcacgaaaatggtcatactgcccaaggtaatttatagattcagtgctatccccatcaagctaccattgactttcttcacagacttggaaaaaaactactttaaagctcacatggaaccaaaaaagagcctgcatagccaagacaatcctaagcaaaaagaacaaagctggaggcatcacgctacctgacttcaaaccatactacaaggctacagtaactaaaacagcatggtactggtaccaaaatagatatatagactaatggaacagaacagaggcctcagaaatgacaccacacatctgcaaccatctgatctttgacaaacctgacaaaaacaagaaatggggaaaggattccctatttaataaatggtgctaggaaaactggctagccatatgtagaaagctgaaactggatcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagttggcaaagg

SEQ ID NO: 1241 - DNA, 5592 bp, synthetic construct
  misc_feature 1..5592: note = Synthetic polypeptide
  source 1..5592: mol_type = other DNA
atgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggaaccagggaaaatgtgtagagggcatggtggagatcttcgacatgctgctggctacatcatctcggttccgcatgatgaatctgcagggagaggagtttgtgtgcctcaaatctattattttgcttaattctgtcttgacaactggaagaccaggagataccctcccttgcctggctcagtgggtcacacgcccatggagacttgctcactgctagcgcagcagtctgagatcaacctgcaatgctgctgcttgatgcggggaggggcgtctgccattgatgaagcttgagtagctcacagcgtaaacaaagcagcagggaagcttgaactgggcagagcccacctcagctcagcaaggcctactgcctctctagattccacctctgggggcagcacatagcagaacaaaaggcagcagacagcttccgcagacttaaacatccctgtctgacacctctgaagagggcagtggttctctcagcacagtgttcaagctccaagaaccaagagaccgccacctcaagcaggtccctgacccccatgtagcctgactgggagacacctcccagtaggggccgacagacacttcaaacaggcaggtgccctctgggacgaagcttccagaggaaggatcaggcagcaatatttgttgttctgcagcctccgctggtgatacccaggcaaacagggtctggggtggacctccagcaaactccaacaggcctgcagctgaggggcctgacggttagaaggaaaactaacaaacagaaaggaatagcatcaacatcaacaaaaaggacatccacaccaaaaccccatctgtaggtcatcaacatcaaagaccaaaggtagataaaaccacaaagatggggagaaaccagagcagaaaagtggaaaattccaaaaaccagagcgcctcttctgctccaaaggattgcagctcctcaccagcaagggaacaaaacaggatggagaatgagtttgatgagttgacagaagtaggcttcagaaggtcggtaataacaaacttctccaagctaaaggaacatgttctaacccatcgcaaggaggctaaaaaccttgaaaaaaggttagatgaatggctaactagaataaacagtgtagagaagaacttaaatgacctgatggagctgaaaaccacagcatgagaacttcgtgatgtatgcacaagcttcgatagctgatttgatcaagtggaagaaaggatatcagtgattgaagatcaaattaatgaaataaagtgagaagacaagatgagagaaaagaagagtgaaaagaaacgaacaaagcctccaagaaatatgggactatgtgaaacaaacaaatatatgtttcattggtgtactgggaagtgatggggagaatggaaccaagttagaaaacactcttcaggatattatccaggacaacttccccaacctagcaaggcaggccaacattcaaattcaggaaatacagagaacactacaaagatactcctcaagaagagcaaccccaagacacataattttcagatttaaaaagtatgaaatgaaggaaaaaatgttaagggcagccagagagaaaagtcgggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggagacccatctcacgtgcaaaaatgcacataggctcaaaataaagggtcgaaggaaaatctactgagcaaatggaaagaaaaaaaaaagcaggggttgcaatcccagtctctgataaaacagaatttaaaccaacaaagatcaaaagagacaaagacagccacaacaagaagagctaactaccctaaatatatatgcacccagtacaggagcacccagattcataaagcaagtccttagagacctacgaagagacatagactcccacacaataataatgggagactgggagacaccccacagtcaatattaaacagatcaacaagacagaaggttaacaaggatatccaggacttgaactcagctctagaccaagtggacccaatagacatctacagaactctccacccctaatcaacagaatatacattcttctcagcaccacattgcacttattttaaaattgaccacataattggaagtaaaacactcctcagcaaatgtaaaagaacagaagtcacaacaaactgtctctcagaccacagtgcaatcaaattagaactcaggattaagaaactgactcaaatccacacagctacgtggaaactgaacaacctgctcctgaatgactactgggtaaataacaaaatgaaggcagaaataaagatgttctttgaaaccaatgagaacaaggacacaatgtaccagaatttctgggacacatttaaagcagtgtgtagagggaaatttatagcactaaatgcccacgagagaaagcaggaaagatctaaaatcgacaccctaacatcacaattgaaagaactagagaagcaagagcaaacaaattcaaaagcaagcagaaggcaagaaataactgagatcagagcagaactgaaggagacagagacacaaaaagccgttcaaaaaatcaatgaatccaggagctggttttttgaaaagatcaacaaaattgatagaccactagcaagactaataaagaagaaaagagagaagaatcgaatagatgcaataaaaaatgataaagggatatcaccaccgatcccacagaaatacaaactaccatcagagaatactataaactcctctacgcaaataaactggaaaatctagaagaaatggataaattcctggacacatacaccctcccaagactcaaccaggaagaagttgaatctctgaagacaccaataacaggtactgaaccaaggtttggaccaaccaaaaatgtccaggaccagatggattcacagttgaattctaccagaggtacaaagaggagctggtaccattccttcagaaactattccaatcaatagaaaaagagggactcctccctaactcattttatgaggccagcatcatcctggtaccaaaacctggcagagacacaacaaaaaaagagaattttaggctaatatccctgatgaacatcgatgtgaaaatcctcaataaaatactggcaaaccaaatccagcagcacatcaaaaagcctatccaccaaaaccaagtcagcttcattcctgggatgcaagactggttcaacatacgcaaataaataaatgtaatccatcacataaacagaaccaatgacaaaaaccacatgattatctcaatagatgcagaaaaggcctttgacaaaattcaacagcctttcttgctaaaaactctaaataaattaggtattgatggaacgtacctcaaaataataagagctatttatgacaaacccacagccaatatcatactgaatgggcaaaacctggaagcattccttttgaaaaccagcacaagataagaatgccctctctcaccactcctattcaacatagtgttggaagttctggctagggcaatcaggcaagagaaagaaataaagggtattcagttaggaaaagaggaagtcaaattgtctctgtttgcagatgacacgattgtatatttagaaaaccccattgtctcagcccaaaatctccttaagctgataagcaacttcagcaaagtctcaggatacaaaatcaatgtgcaaaaatcacaggcattcctgtacaccaataatagacaaacagagagccaaatcatgagtgaactcccattcagaattactacaaagagaataaaatacctaggaatccaacttacaagggatgtgaaggacctcttcaaggagaactacaaaccactgctcaacgaaataaaagaggacacaaacaaatggaagaacattccatgctcgtggataggaataatcaatatcacgaaaatggtcatactgcccaaggtaatttatagattcagtgctatccccatcaagctaccattgactttcttcacagacttggaaaaaaactactttaaagctcacatggaaccaaaaaagagcctgcatagccaagacaatcctaagcaaaaagaacaaagctggaggcatcacgctacctgacttcaaaccatactacaaggctacagtaactaaaacagcatggtactggtaccaaaatagatatatagactaatggaacagaacagaggcctcagaaatgacaccacacatctgcaaccatctgatctttgacaaacctgacaaaaacaagaaatggggaaaggattccctatttaataaatggtgctaggaaaactggctagccatatgtagaaagctgaaactggatcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagttggcaaagg

SEQ ID NO: 1242 - DNA, 5856 bp, synthetic construct
  misc_feature 1..5856: note = Synthetic polypeptide
  source 1..5856: mol_type = other DNA
atggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctgtcttgacaactggaagaccaggagataccctcccttgcctggctcagtgggtcacacgcccatggagacttgctcactgctagcgcagcagtctgagatcaacctgcaatgctgctgcttgatgcggggaggggcgtctgccattgatgaagcttgagtagctcacagcgtaaacaaagcagcagggaagcttgaactgggcagagcccacctcagctcagcaaggcctactgcctctctagattccacctctgggggcagcacatagcagaacaaaaggcagcagacagcttccgcagacttaaacatccctgtctgacacctctgaagagggcagtggttctctcagcacagtgttcaagctccaagaaccaagagaccgccacctcaagcaggtccctgacccccatgtagcctgactgggagacacctcccagtaggggccgacagacacttcaaacaggcaggtgccctctgggacgaagcttccagaggaaggatcaggcagcaatatttgttgttctgcagcctccgctggtgatacccaggcaaacagggtctggggtggacctccagcaaactccaacaggcctgcagctgaggggcctgacggttagaaggaaaactaacaaacagaaaggaatagcatcaacatcaacaaaaaggacatccacaccaaaaccccatctgtaggtcatcaacatcaaagaccaaaggtagataaaaccacaaagatggggagaaaccagagcagaaaagtggaaaattccaaaaaccagagcgcctcttctgctccaaaggattgcagctcctcaccagcaagggaacaaaacaggatggagaatgagtttgatgagttgacagaagtaggcttcagaaggtcggtaataacaaacttctccaagctaaaggaacatgttctaacccatcgcaaggaggctaaaaaccttgaaaaaaggttagatgaatggctaactagaataaacagtgtagagaagaacttaaatgacctgatggagctgaaaaccacagcatgagaacttcgtgatgtatgcacaagcttcgatagctgatttgatcaagtggaagaaaggatatcagtgattgaagatcaaattaatgaaataaagtgagaagacaagatgagagaaaagaagagtgaaaagaaacgaacaaagcctccaagaaatatgggactatgtgaaacaaacaaatatatgtttcattggtgtactgggaagtgatggggagaatggaaccaagttagaaaacactcttcaggatattatccaggacaacttccccaacctagcaaggcaggccaacattcaaattcaggaaatacagagaacactacaaagatactcctcaagaagagcaaccccaagacacataattttcagatttaaaaagtatgaaatgaaggaaaaaatgttaagggcagccagagagaaaagtcgggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggagacccatctcacgtgcaaaaatgcacataggctcaaaataaagggtcgaaggaaaatctactgagcaaatggaaagaaaaaaaaaagcaggggttgcaatcccagtctctgataaaacagaatttaaaccaacaaagatcaaaagagacaaagacagccacaacaagaagagctaactaccctaaatatatatgcacccagtacaggagcacccagattcataaagcaagtccttagagacctacgaagagacatagactcccacacaataataatgggagactgggagacaccccacagtcaatattaaacagatcaacaagacagaaggttaacaaggatatccaggacttgaactcagctctagaccaagtggacccaatagacatctacagaactctccacccctaatcaacagaatatacattcttctcagcaccacattgcacttattttaaaattgaccacataattggaagtaaaacactcctcagcaaatgtaaaagaacagaagtcacaacaaactgtctctcagaccacagtgcaatcaaattagaactcaggattaagaaactgactcaaatccacacagctacgtggaaactgaacaacctgctcctgaatgactactgggtaaataacaaaatgaaggcagaaataaagatgttctttgaaaccaatgagaacaaggacacaatgtaccagaatttctgggacacatttaaagcagtgtgtagagggaaatttatagcactaaatgcccacgagagaaagcaggaaagatctaaaatcgacaccctaacatcacaattgaaagaactagagaagcaagagcaaacaaattcaaaagcaagcagaaggcaagaaataactgagatcagagcagaactgaaggagacagagacacaaaaagccgttcaaaaaatcaatgaatccaggagctggttttttgaaaagatcaacaaaattgatagaccactagcaagactaataaagaagaaaagagagaagaatcgaatagatgcaataaaaaatgataaagggatatcaccaccgatcccacagaaatacaaactaccatcagagaatactataaactcctctacgcaaataaactggaaaatctagaagaaatggataaattcctggacacatacaccctcccaagactcaaccaggaagaagttgaatctctgaagacaccaataacaggtactgaaccaaggtttggaccaaccaaaaatgtccaggaccagatggattcacagttgaattctaccagaggtacaaagaggagctggtaccattccttcagaaactattccaatcaatagaaaaagagggactcctccctaactcattttatgaggccagcatcatcctggtaccaaaacctggcagagacacaacaaaaaaagagaattttaggctaatatccctgatgaacatcgatgtgaaaatcctcaataaaatactggcaaaccaaatccagcagcacatcaaaaagcctatccaccaaaaccaagtcagcttcattcctgggatgcaagactggttcaacatacgcaaataaataaatgtaatccatcacataaacagaaccaatgacaaaaaccacatgattatctcaatagatgcagaaaaggcctttgacaaaattcaacagcctttcttgctaaaaactctaaataaattaggtattgatggaacgtacctcaaaataataagagctatttatgacaaacccacagccaatatcatactgaatgggcaaaacctggaagcattccttttgaaaaccagcacaagataagaatgccctctctcaccactcctattcaacatagtgttggaagttctggctagggcaatcaggcaagagaaagaaataaagggtattcagttaggaaaagaggaagtcaaattgtctctgtttgcagatgacacgattgtatatttagaaaaccccattgtctcagcccaaaatctccttaagctgataagcaacttcagcaaagtctcaggatacaaaatcaatgtgcaaaaatcacaggcattcctgtacaccaataatagacaaacagagagccaaatcatgagtgaactcccattcagaattactacaaagagaataaaatacctaggaatccaacttacaagggatgtgaaggacctcttcaaggagaactacaaaccactgctcaacgaaataaaagaggacacaaacaaatggaagaacattccatgctcgtggataggaataatcaatatcacgaaaatggtcatactgcccaaggtaatttatagattcagtgctatccccatcaagctaccattgactttcttcacagacttggaaaaaaactactttaaagctcacatggaaccaaaaaagagcctgcatagccaagacaatcctaagcaaaaagaacaaagctggaggcatcacgctacctgacttcaaaccatactacaaggctacagtaactaaaacagcatggtactggtaccaaaatagatatatagactaatggaacagaacagaggcctcagaaatgacaccacacatctgcaaccatctgatctttgacaaacctgacaaaaacaagaaatggggaaaggattccctatttaataaatggtgctaggaaaactggctagccatatgtagaaagctgaaactggatcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagttggcaaagg

SEQ ID NO: 1243 - DNA, 232 bp, synthetic construct
  misc_feature 1..232: note = Synthetic polypeptide
  source 1..232: mol_type = other DNA
atgacactggcaactgacggcactgcggatatgtttggaataagatggggtcaggccacaagccaaggaacggaggcagcctcttgaacctgaaaaaggcaagaaaatggattctcccctagtgccttcagaaggaacgtggacaagcagaactgtaagataataaatttgtgttgttttacgcctttaagtttttggtaatttgttacagcaacagtgggaaactagtgca

SEQ ID NO: 1244 - DNA, 3013 bp, synthetic construct
  misc_feature 1..3013: note = Synthetic polypeptide
  source 1..3013: mol_type = other DNA
atgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagggacatggatgaagctggaaaccatcattctgagcaaactatcgcaaggacagaaaaccaaacatcacatgttctcacccataggtgggaattgaacaatgagaacacttggacacaggaagtgcaacatcacacacgggggcctgtcatggggtggggggaggtgggagggatagcattaagagaaatacctaatgtaaatgacgagttaatgggtgcagtgcaccaatatggcacatgtatacatatgtaaaaaacctgcacgttgtgcagatgtactctagaacttaatgtataataacaacaaaaaaa

SEQ ID NO: 1245 - DNA, 3370 bp, synthetic construct
  misc_feature 1..3370: note = Synthetic polypeptide
  source 1..3370: mol_type = other DNA
atgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagggacatggatgaagctggaaaccatcattctgagcaaactatcgcaaggacagaaaaccaaacatcacatgttctcacccataggtgggaattgaacaatgagaacacttggacacaggaagtgcaacatcacacacgggggcctgtcatggggtggggggaggtgggagggatagcattaagagaaatacctaatgtaaatgacgagttaatgggtgcagtgcaccaatatggcacatgtatacatatgtaaaaaacctgcacgttgtgcagatgtactctagaacttaatgtataataacaacaaaaaaa

SEQ ID NO: 1246 - DNA, 617 bp, synthetic construct
  misc_feature 1..617: note = Synthetic polypeptide
  source 1..617: mol_type = other DNA
atgcggccggggggcgcactgctcgccctgctcgccagcctgctgctgctgctgctgctgcgcctgctctggtgcccggcagacgcgcccggccgcgccaggattctggtggaggaaagcagggaggccacccacggcacccccgcagcgctgaggacgctccggagcccggcgaccgcggtaccgcgcgccactaacagcacatatctgaatgagaagtcgctccaactgacggagaaatgcaaaaatctgcaatatggcattgagtctttctctaacaaaacgaaagggcccagtcccaaggcgcaaggcggcttacgtcatcagcgtgcgtcagcaagatagcagaagcggggagagagctgttctgaagacccagagagaggcctaccgggtatcacgtagcagtagatacacagactgaaacacttcctgtttacgggagactgtaaaacccctgcccgtcctcatttggggctgatgccattttaggcctcggcctgaaatggcctgaaggtctgccttcaggcattcattaaaactgcctgttgctccacactgccttgtgttgtttgttggcgttctctcagggttcgaaccaatacaagagccttgca

SEQ ID NO: 1247 - DNA, 1731 bp, synthetic construct; identical to SEQ ID NO: 989
  misc_feature 1..1731: note = Synthetic polypeptide
  source 1..1731: mol_type = other DNA

SEQ ID NO: 1248 - DNA, 2262 bp, synthetic construct; identical to SEQ ID NO: 990
  misc_feature 1..2262: note = Synthetic polypeptide
  source 1..2262: mol_type = other DNA

SEQ ID NO: 1249 - DNA, 2253 bp, synthetic construct; identical to SEQ ID NO: 991
  misc_feature 1..2253: note = Synthetic polypeptide
  source 1..2253: mol_type = other DNA

SEQ ID NO: 1250 - DNA, 3005 bp, synthetic construct
  misc_feature 1..3005: note = Synthetic polypeptide
  source 1..3005: mol_type = other DNA
atggagccctcctggcttcaggaactcatggctcaccccttcttgctgctgatcctcctctgcatgtctctgctgctgtttcaggtaatcaggttgtaccagaggaggagatggatgatcagagccctgcacctgtttcctgcaccccctgcccactggttctatggccacaaggagttttacccagtaaaggagtttgaggtgtatcataagctgatggaaaaatacccatgtgctgttcccttgtgggttggaccctttacgatgttcttcagtgtccatgacccagactatgccaagattctcctgaaaagacaagatcccaaaagtgctgttagccacaaaatccttgaatcctgggttggtcgaggacttgtgaccctggatggttctaaatggaaaaagcaccgccagattgtgaaacctggcttcaacatcagcattctgaaaatattcatcaccatgatgtctgagagtgttcggatgatgctgaacaaatgggaggaacacattgcccaaaactcacgtctggagctctttcaacatgtctccctgatgaccctggacagcatcatgaagtgtgccttcagccaccagggcagcatccagttggacagtaccctggactcatacctgaaagcagtgttcaaccttagcaaaatctccaaccagcgcatgaacaattttctacatcacaacgacctggttttcaaattcagctctcaaggccaaatcttttctaaatttaaccaagaacttcatcagttcacagagaaagtaatccaggaccggaaggagtctcttaaggataagctaaaacaagatactactcagaaaaggcgctgggattttctggacatacttttgagtgccaaaagcgaaaacaccaaagatttctctgaagcagatctccaggctgaagtgaaaacgttcatgtttgcaggacatgacaccacatccagtgctatctcctggatcctttactgcttggcaaagtaccctgagcatcagcagagatgccgagatgaaatcagggaactcctaggggatgggtcttctattacctgggaacacctgagccagatgccttacaccacgatgtgcatcaaggaatgcctccgcctctacgcaccggtagtaaacatatcccggttactcgacaaacccatcacctttccagatggacgctccttacctgcaggcaaacagagagccaaatcatgagcgaactcccattcacaattgcttcaaggagaataaaatatctaggaatccaacttacaagggatgtgaaggacctcttcaaggagaactacaaaccgctgctcaatgaaataaaagaggatacaaacaaatggaagaacattccatgctcctgggtaggaagaatcaatatcgtgaaaatggccatactgcccaaggtaatttatagtttcaatgccatccctatcaagctaccaatgactttcttcacagaattggaaaaaactactttaaagttcatatggcaccaaaaaagagtccgcatcgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaacctgacaaaaacaagaaatggggaaacgattccctttttaataaatggtgctaggaaagctggctagccatatgcagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatcttattaaactaaagagcttctgcacagcaaaagaaattaccatcagagtgaacaggcaacctacagaatgggagaaaatttttgcaatctcctcatctgacaaagggctaacatccagaatctacaatgaactcaaacaaatttacaagaaaaaaacaaacaaccccatcaacaagaaggtgaaggatatgaacagacacttctcaaaagaagacatttatgcagccaacagacacatgaaaaaatgctcatcatcactggccatcagagaaatgcaaatcaaaaccacaatgagataccatctcacaccagttagaaaggcgatcattaaaaagtcaggaaacaacaggtgctggagaggatgtggagaaatagggacacttttacactgttggtgggactgtaaactagttcaaccattgtggaagtcagtgtggcgatttctcagggatctagaactagaaataccatttgacccagccatcccattactaggtatatacccaaaggattataaatcgtgccgctataaagacacatgcacacgtatgtttattgtggcactattcacaatagcaaagacttggaaccaacccaaatgtccaacaatgatagactggattaagaaaatgtggctcatatacactatggaatactatgcagccataaaaaatgatgagttcatgtcctttgtagggacacggatgaagctggaaaccatcattctcagcaaactatcgcaaggacaaaaaaccaaacgccgcatgttctcactcataggtgggaattgagcagtgagaacacattgacacaggaaggggaacatcacacaccagagcctgttgtggggtggagggaggggggatggatagcattaggagatatacctaatgttaaatgacgagttaatgggtgcagcacaccaacatggcacatgtatacatatgtaacaaaccttcatgttgtgcatatgtaccctaaaacttaaagtataattttaaaaaaaaa

SEQ ID NO: 1251 - DNA, 1382 bp, synthetic construct
  misc_feature 1..1382: note = Synthetic polypeptide
  source 1..1382: mol_type = other DNA
atggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggaaacaaaccatcaggcctcccagaaagtatccgggatctgaaaatcaccaaatcaccacatccggacagtgagaagccagatccctcacccttcttgattggctgacaaaccaactgcttcctgttgaccaactcctcttccttatccctccctaattcctgttttcccacacatggtttcacttcttccctgctatacaaacacctaattttagttggtcagggagatggaattgagactgatctcttgtctccttggctgctgcacctgattaaagccttcttccttggcaatactcattgtctcagtgtttgcctttctgtgcagtgagaaaacaggacctagatggaactcctgctgttttggtaaca

SEQ ID NO: 1252 - DNA, 3047 bp, synthetic construct
  misc_feature 1..3047: note = Synthetic polypeptide
  source 1..3047: mol_type = other DNA
atggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggtaccagctcagccacaatgggctagaacgccaagcgggctgttggggtgcctgattccatgcctaggctcttggacagctttggaccagacaagccttggatagccttctggacttgtcgtgggccagaggggagcccactgccctgaagggtgagttctggggttggcagcattcaccacagctgactgaagagcacttgggctttcagtgaatatcggcagtggcctggcagagctctccatgggctggtggtggtggtggcaactgggagtgggagaggctcctctgcctgtggaaaagggagggaaggactgacttgtcttatggttttagggccagcttagcctcagtaaaatagaacaccaggtagatttctaaggttttttcctccaatccctagctcccagacagcatctctggacccacccagggcctggggtaacttgcttccctgaaggaaaggacaaaaacctggctggcttccccacctgctaattgtagagccctagggccttgagtaaagataggtggtagccaggtagtgattgcagtgggccttgggcgagacccagtgctgtactggctccagatacaacccagtgcagtcccagtggtggtggccacagggtttttgcatcactccaccccaggatccaagtggctcagcacaggagagactccatttgtttgggagaaaataagggaagagaacaagagtctctgtctgataatccagataattcttctggatcttatccaagactaccatgtcactacctctatgagttttcaagaaccacagtgttattcggcttgggacccaattctcttccaatacctggaaaaccttaccaagaaaaatgggcacaaacgtgcccaaattgcgaagactacaataaattctaactcttcaatgtttaaacgccaatgactatccacaatcatcgagatcatccagggaaacacaacctcaccaaactaaataagacaccagggaccagtcctggagaaagagatatgcaacctttcagagaattcaaaataactgttttgaggaaactcaaagaaatttaagataacacagaaagcaaattcagaattctatcatataaatataaaaaagagattgaaataattaaaaagaaccaagcagaaattctagagttgaaaaatggaattgacatagtgaagaatgcatcagtctcttaatagcagaattaagcagaagaatttgtgagcttgaagacagactacttaaaaatacacagaggaaacaaaagaataaaacacacttaaaagatctagaaaacagcctcaaaagggcaaatctaagagttattggccttaaggaggagatcgagaaagagacagggatagaaagtttattcagagggatagtgtcagagaacttcccaaatctagaaaaagataccaacattcaagcacaagaaggttatagaacagttttaacctaaagaagactacctcaaggcatttaataatcaagctcccagaggtcaagggtaaagaaagcatcctaaaagcatcaagaaaaaaagaaacaacatataatggagctccaacacatctggcagcagacttttcagtggaaacctaaacaggctaggagagagtggcatgacatatttaaagtgctaaaggaaaaacaaacaaaaaaaaatttaccctagaacagtgtatcttgtgaaaatatccttcaagcatgaagaagaaataaagactgtcagacaaacaaaagctgagggattttgtcagcactacacctgtcctataagaaatgctaaagggaattcttcagtcagaaggaaaagtatgttaatgagcaataagaaattatatgaaggtacaaaactcactggtaatagtaaacacacaaatcagaatattataacactgtaattatggtttgtaaactactcttaagtagaaagactagttgatgaaccaatcaaaaataataactaggataacttttcaaaacatgggacaataagacataagcaacaaaaagttaaaaagtcagagaattaagtgaaaatgtttttattagtttttttttgcctatttgtttatgcaatcagtgttaagttgtcatcagcttaataataatgggttataagatacttgcaagcctcatgataacctcaaatcaaaaaacatatatacaaaaataaaaagcaatacattaaaatataccaacagagaaaactaccttcactaaaggaagacaggaagcaaggaaagaagaaagagaagaccagaaaacaaataacagaatggcagaagcaagtccttacctaatcaataatgacattgaatgtaaatggactaaaaactctcctatcaaaagacatagagta

SEQ ID NO: 1253 - DNA, 1743 bp, synthetic construct
  misc_feature 1..1743: note = Synthetic polypeptide
  source 1..1743: mol_type = other DNA
atgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgtggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaaggtcactcactccagaggaagccagctgctgtgtcatgaggcactcaagcagccatatggagaggctgatgtggtagggaactgagacctcctgccaacagccagcatcgtcttgccaggagggtgagtcatcttgaaagtggatcctctagccccacgcaagccttcagaagactacagccaaccctgagtaacatcttcactgcaacttcaagagagaccctgaaccaaaaatacccagctaagcctctctcagattcccagtccacagaaactgtgaaatagatgtttatagtttaagcgactaagctttggggtaatttgtcatgtagcaata

SEQ ID NO: 1254 - DNA, 1518 bp, synthetic construct
  misc_feature 1..1518: note = Synthetic polypeptide
  source 1..1518: mol_type = other DNA
atgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgtggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaaggtcactcactccagaggaagccagctgctgtgtcatgaggcactcaagcagccatatggagaggctgatgtggtagggaactgagacctcctgccaacagccagcatcgtcttgccaggagggtgagtcatcttgaaagtggatcctctagccccacgcaagccttcagaagactacagccaaccctgagtaacatcttcactgcaacttcaagagagaccctgaaccaaaaatacccagctaagcctctctcagattcccagtccacagaaactgtgaaatagatgtttatagtttaagcgactaagctttggggtaatttgtcatgtagcaata

SEQ ID NO: 1255 - DNA, 1767 bp, synthetic construct
  misc_feature 1..1767: note = Synthetic polypeptide
  source 1..1767: mol_type = other DNA
atggctcggagcctctccatcatgttcgtccccaacagctggctcaatggctaccacaaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgtggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaaggtcactcactccagaggaagccagctgctgtgtcatgaggcactcaagcagccatatggagaggctgatgtggtagggaactgagacctcctgccaacagccagcatcgtcttgccaggagggtgagtcatcttgaaagtggatcctctagccccacgcaagccttcagaagactacagccaaccctgagtaacatcttcactgcaacttcaagagagaccctgaaccaaaaatacccagctaagcctctctcagattcccagtccacagaaactgtgaaatagatgtttatagtttaagcgactaagctttggggtaatttgtcatgtagcaata

SEQ ID NO: 1256 - DNA, 1178 bp, synthetic construct
  misc_feature 1..1178: note = Synthetic polypeptide
  source 1..1178: mol_type = other DNA
atggacgcgcaggactgccaggcggccgcatcgcccgagccgcccgggcccccagcccgtagctgcgtggccgcctggtgggacatggtcgaccgcaacctgcgatattttccacactcctgttcaatgctcggaagaaaaattgctgctctgtatgacagctttactagtaaatccttaaaagaacacgttttccttcctctgatagacatgctaatttattttaattttttcaaagccccatttcttgtggatttaaagaaaccagagttaaagattcctcacacagtgaacttctacctgagagttgaacctggggtgatgctagggatctggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaaggtatctgcccagatggcctgaagtaactgaagaatcacaaaagaagtgaatatgccctgccccaccttaactgatgacattccaccacaaaagaagtataaatggccggtccttgccttaagtgatgacactaccttgtgaaagtccttttcctggctcatcctggctcagaagctcccccactgagcaccttgtgacccccacccctgcccaccagagaacaaccccctttgactgtaattttccattaccttcccaaatcctataaaacagccccacccctatctcccttggctgactctcttttcggactcagcccacctgcacccaggtgaaataaacagccatgttgctcacacaaagcctgtttggtggtctcttcacacggacgcgcatga

SEQ ID NO: 1257 - DNA, 947 bp, synthetic construct
  misc_feature 1..947: note = Synthetic polypeptide
  source 1..947: mol_type = other DNA
atggacgcgcaggactgccaggcggccgcatcgcccgagccgcccgggcccccagcccgtagctgcgtggccgcctggtgggacatggtcgaccgcaacctgcggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaaggtatctgcccagatggcctgaagtaactgaagaatcacaaaagaagtgaatatgccctgccccaccttaactgatgacattccaccacaaaagaagtataaatggccggtccttgccttaagtgatgacactaccttgtgaaagtccttttcctggctcatcctggctcagaagctcccccactgagcaccttgtgacccccacccctgcccaccagagaacaaccccctttgactgtaattttccattaccttcccaaatcctataaaacagccccacccctatctcccttggctgactctcttttcggactcagcccacctgcacccaggtgaaataaacagccatgttgctcacacaaagcctgtttggtggtctcttcacacggacgcgcatga

SEQ ID NO: 1258 - DNA, 857 bp, synthetic construct
  misc_feature 1..857: note = Synthetic polypeptide
  source 1..857: mol_type = other DNA
atgctagggatctggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaaggtatctgcccagatggcctgaagtaactgaagaatcacaaaagaagtgaatatgccctgccccaccttaactgatgacattccaccacaaaagaagtataaatggccggtccttgccttaagtgatgacactaccttgtgaaagtccttttcctggctcatcctggctcagaagctcccccactgagcaccttgtgacccccacccctgcccaccagagaacaaccccctttgactgtaattttccattaccttcccaaatcctataaaacagccccacccctatctcccttggctgactctcttttcggactcagcccacctgcacccaggtgaaataaacagccatgttgctcacacaaagcctgtttggtggtctcttcacacggacgcgcatga

SEQ ID NO: 1259 - DNA, 582 bp, synthetic construct
  misc_feature 1..582: note = Synthetic polypeptide
  source 1..582: mol_type = other DNA
atgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggaggctgaggcaggaagatcacttgagcccaggagtttgaggctgcggtaagctatgattgtgtcactgcaccccaaactgggtgacatatgaagacattatctctaaaaaaattttttaaataaaaaacaaaaaa

SEQ ID NO: 1260 - DNA, 1215 bp, synthetic construct
  misc_feature 1..1215: note = Synthetic polypeptide
  source 1..1215: mol_type = other DNA
atgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacaagacttcccacaggtgaagagaccactaaaagcatccaggaccagacagccatccaggaccaaccttccagttctgtctgtgaacgaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggaggctgaggcaggaagatcacttgagcccaggagtttgaggctgcggtaagctatgattgtgtcactgcaccccaaactgggtgacatatgaagacattatctctaaaaaaattttttaaataaaaaacaaaaaa

SEQ ID NO: 1261 - DNA, 705 bp, synthetic construct
  misc_feature 1..705: note = Synthetic polypeptide
  source 1..705: mol_type = other DNA
atgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggaggctgaggcaggaagatcacttgagcccaggagtttgaggctgcggtaagctatgattgtgtcactgcaccccaaactgggtgacatatgaagacattatctctaaaaaaattttttaaataaaaaacaaaaaa

SEQ ID NO: 1262 - DNA, 436 bp, synthetic construct
  misc_feature 1..436: note = Synthetic polypeptide
  source 1..436: mol_type = other DNA
atgacactggcaactgacggcactgcggatatgtttggaataaggttcaaaagaagaggctgttctaagaaagactaccgagtaatcaatcacctcctcagagaaagtctgctcaggccaggcatggtggctcacgcctgtaatcccagcgctttgggaggctgaggtggacggatcacctgaggtcaggagttcgagaccaacccggccaacatagtgaaaccctgtctctactaaaaatacaaaaaaattagctgggcatggtggcatgtgcctgtaatcccagctacccaggaggctgaggcaggagaatcgcttgaacccaggaggcagaggttgcagtgagccgagatggtgccaatgcactccagcctgggcaacagagcaggactccgtttcacacacacacacaaaaaaaaaaaaaaaaaaaaaaaaa

SEQ ID NO: 1263 - DNA, 1834 bp, synthetic construct; identical to SEQ ID NO: 133
  misc_feature 1..1834: note = Synthetic polypeptide
  source 1..1834: mol_type = other DNA

SEQ ID NO: 1264 - DNA, 1765 bp, synthetic construct; identical to SEQ ID NO: 135
  misc_feature 1..1765: note = Synthetic polypeptide
  source 1..1765: mol_type = other DNA

SEQ ID NO: 1265 - DNA, 980 bp, synthetic construct; identical to SEQ ID NO: 139
  misc_feature 1..980: note = Synthetic polypeptide
  source 1..980: mol_type = other DNA

SEQ ID NO: 1266 - DNA, 1256 bp, synthetic construct; identical to SEQ ID NO: 140
  misc_feature 1..1256: note = Synthetic polypeptide
  source 1..1256: mol_type = other DNA

SEQ ID NO: 1267 - DNA, 1277 bp, synthetic construct; identical to SEQ ID NO: 142
  misc_feature 1..1277: note = Synthetic polypeptide
  source 1..1277: mol_type = other DNA

SEQ ID NO: 1268 - DNA, 3371 bp, synthetic construct
  misc_feature 1..3371: note = Synthetic polypeptide
  source 1..3371: mol_type = other DNA
atgccaggacaccccgaaagccggaaaacgagacgcattctcactatgttgcccaggctggtcttgaactccttccctcaagtgattcttctgcctaatcctcccaaagttcttagattacagggactactggcattcagtgatgtggtcatagaattctctccagaggagtgggcatgcctggaccctgcccagcgaaatttgtatagggatgtgatgttcgagaactacagaaacctggtctccctggctattttatcttattccattcaagaccttttgccagagcaggatatgaaagatttatgccaaaaagtgacactgacaagacatagaagctggggccttgacaatttgcacttagtgaaagactggagaactgtgaatgaaggtaaggggcagaaagaatattgcaatagacttactcaatgttcatcaactaaaagcaaaatctttcaatgtattgaatgtggcagaaattttagctggaggtcaatccttactgaacataagagaattcatactggagagaagccatacaaatgtgaagaatgtggcaaagttttcaatcgatgttcaaacctaacaaaacataaaagaattcatactggagagaaaccctacaaatgtgacgaatgtggcaaagtttttaattggtggtcacaactaactaaccataagaaaattcatactggagagaaaccctacaaatgtgatgaatgtgacaaagtttttaattggtggtcacaactaactagccataagaaaattcatagtggagagaaaccatacccatgtgaagaatgtggcaaagcctttacccagttctcaaaccttacacaacataagagaattcatactggagagaaaccctacaaatgcaaagaatgttgcaaagcctttaacaagttctcaaaccttactcaacataagagaattcatactggagagaaaccttacaagtgtgaagaatgtggcaacgtttttaatgagtgctcacacctaactagacataggagaattcatactggagagaaaccctacaaatgtgaagaatgtggcaaagcctttacacagtttgcaagccttactcgtcataaaagaattcatactggagaaaaaccctaccaatgtgaagaatgtggcaaaacttttaatcggtgttcacacctaagtagccataagagaattcatactggagagaaaccctacaaatgtgaagaatgtggcagaacctttactcaattctcaaacctcactcagcataaaagaattcatactggagagaaaccctacaaatgcaaagaatgtggcaaagcgtttaacaagttctcaagccttactcaacataggagaattcatactggagtgaaaccctacaaatgtgaagaatgtgggaaagtttttaaacagtgctctcacctaactagccataagagaattcatactggagagaaaccctacaaatgtaaagaatgtggcaaagctttttaccaatcctcaatccttagtaagcataagagaattcatactgaagagaaaccctacaaatgtgaagaatgtggcaaagcctttaaccagttctcaagccttactcgtcataaaagaattcatactggagagaaacgctacaaatgtaaagaatgtggaaaaggtttttaccaatcctcaatccatagttaaaaggactactgactcaaactctgcctcttgagttcatggttcaccacttccagcctggtgacttggtgctgattaaaacttggaaagaagacaagctccacccaagttgggaagctccctatcaagtgctcctgaccactaagatggctggatgtgcaaacagctgaacaaaggtggactcactacactcaagtcaagggactggtaaaagggaccccagaaggcaaggaaaaagaccagtggaaagtgcatgggtcacctgaggaacccttaaagttaactcttggaaaaatctaaaaggaaaacatgggctggccccatttctggaagttaatatggctgggatgggctactatacaaagagcagaaggtcaaaatggaaactggcaggggactcttccctacccaatcaggttggcaattaatgtgaccaagacgatggcacctcagaatataagatttgatacctgccaggttttaacttgtgggaatttagaaaatcagagacagttctcacaggcagataaatatcttttccctgaaccaaatacagtttacagtagggcatcaccctgccccagctgggataatgtatggtggactacccaatttcagggttgaacagtaaacatagaataggtaactctgagctggagacccttaaagaataaactacatctgtccaagggctccctgccaaataactgccagaatttaaaatgcaattctatactcatcaccattgacaatccagccattgtagaccaagaaccaaaagtagaatctgggatatatgcattaggggcagaaatcacagggaaagaccccctagggtgatttgttctcaaactaatcaagaactcaacctcccatttgcctgggactacaaccccagaccctaataaacactttagtccaccaaataatgaccctaaaagggaaaaatatggtaaaggatctaaggcaaaccttagaaattgagacagggtatggggatataaacgcctgggtcgaattggtcaaatttttggtacaagccctcaacaagagtaactgctgtgggatgaccttgggcacaggtggttccatttcccctaggatggaatacccctcctaagggactacactgtatgttggttctataccaggacaaggatgcatgcggaagtaagacttgtaagagtctgtgatcgctctttcccacattccagagctcagatcccagagcaatatccttgttctctatagggaatatgaaccacttctcttgcctctctaggcaggaggaagagttcaataatcctgtgggagaactctcaacttctgcctacatcctaaacatcactggtgagtcaagcaatggcaattactcagctctccatacaccccgggctgatgtctggtggtattgtgggaaatggaacctctgtaacctgttaccatccaatgggactaggacttgtgctttagtccaattggccattcccttcaccctggcattccataagatacccaaaaatacacatggccactgacaccagagagatttgacaaattcttttaatcccaatacatatgttaactcaattggagtccctagaggtgtgcctaatgaatttaggcctaaaaccaaatagctgctgggttttaggactcttctgatggtcaactattaataagaatgtgaa

SEQ ID NO: 1269 - DNA, 3206 bp, synthetic construct
  misc_feature 1..3206: note = Synthetic polypeptide
  source 1..3206: mol_type = other DNA
atgggcacaatatcactttgcattggtgtctgtgcatttgaaggagcaaacacctctaccagtttttataaactggtttatacagctattttatcttattccattcaagaccttttgccagagcaggatatgaaagatttatgccaaaaagtgacactgacaagacatagaagctggggccttgacaatttgcacttagtgaaagactggagaactgtgaatgaaggtaaggggcagaaagaatattgcaatagacttactcaatgttcatcaactaaaagcaaaatctttcaatgtattgaatgtggcagaaattttagctggaggtcaatccttactgaacataagagaattcatactggagagaagccatacaaatgtgaagaatgtggcaaagttttcaatcgatgttcaaacctaacaaaacataaaagaattcatactggagagaaaccctacaaatgtgacgaatgtggcaaagtttttaattggtggtcacaactaactaaccataagaaaattcatactggagagaaaccctacaaatgtgatgaatgtgacaaagtttttaattggtggtcacaactaactagccataagaaaattcatagtggagagaaaccatacccatgtgaagaatgtggcaaagcctttacccagttctcaaaccttacacaacataagagaattcatactggagagaaaccctacaaatgcaaagaatgttgcaaagcctttaacaagttctcaaaccttactcaacataagagaattcatactggagagaaaccttacaagtgtgaagaatgtggcaacgtttttaatgagtgctcacacctaactagacataggagaattcatactggagagaaaccctacaaatgtgaagaatgtggcaaagcctttacacagtttgcaagccttactcgtcataaaagaattcatactggagaaaaaccctaccaatgtgaagaatgtggcaaaacttttaatcggtgttcacacctaagtagccataagagaattcatactggagagaaaccctacaaatgtgaagaatgtggcagaacctttactcaattctcaaacctcactcagcataaaagaattcatactggagagaaaccctacaaatgcaaagaatgtggcaaagcgtttaacaagttctcaagccttactcaacataggagaattcatactggagtgaaaccctacaaatgtgaagaatgtgggaaagtttttaaacagtgctctcacctaactagccataagagaattcatactggagagaaaccctacaaatgtaaagaatgtggcaaagctttttaccaatcctcaatccttagtaagcataagagaattcatactgaagagaaaccctacaaatgtgaagaatgtggcaaagcctttaaccagttctcaagccttactcgtcataaaagaattcatactggagagaaacgctacaaatgtaaagaatgtggaaaaggtttttaccaatcctcaatccatagttaaaaggactactgactcaaactctgcctcttgagttcatggttcaccacttccagcctggtgacttggtgctgattaaaacttggaaagaagacaagctccacccaagttgggaagctccctatcaagtgctcctgaccactaagatggctggatgtgcaaacagctgaacaaaggtggactcactacactcaagtcaagggactggtaaaagggaccccagaaggcaaggaaaaagaccagtggaaagtgcatgggtcacctgaggaacccttaaagttaactcttggaaaaatctaaaaggaaaacatgggctggccccatttctggaagttaatatggctgggatgggctactatacaaagagcagaaggtcaaaatggaaactggcaggggactcttccctacccaatcaggttggcaattaatgtgaccaagacgatggcacctcagaatataagatttgatacctgccaggttttaacttgtgggaatttagaaaatcagagacagttctcacaggcagataaatatcttttccctgaaccaaatacagtttacagtagggcatcaccctgccccagctgggataatgtatggtggactacccaatttcagggttgaacagtaaacatagaataggtaactctgagctggagacccttaaagaataaactacatctgtccaagggctccctgccaaataactgccagaatttaaaatgcaattctatactcatcaccattgacaatccagccattgtagaccaagaaccaaaagtagaatctgggatatatgcattaggggcagaaatcacagggaaagaccccctagggtgatttgttctcaaactaatcaagaactcaacctcccatttgcctgggactacaaccccagaccctaataaacactttagtccaccaaataatgaccctaaaagggaaaaatatggtaaaggatctaaggcaaaccttagaaattgagacagggtatggggatataaacgcctgggtcgaattggtcaaatttttggtacaagccctcaacaagagtaactgctgtgggatgaccttgggcacaggtggttccatttcccctaggatggaatacccctcctaagggactacactgtatgttggttctataccaggacaaggatgcatgcggaagtaagacttgtaagagtctgtgatcgctctttcccacattccagagctcagatcccagagcaatatccttgttctctatagggaatatgaaccacttctcttgcctctctaggcaggaggaagagttcaataatcctgtgggagaactctcaacttctgcctacatcctaaacatcactggtgagtcaagcaatggcaattactcagctctccatacaccccgggctgatgtctggtggtattgtgggaaatggaacctctgtaacctgttaccatccaatgggactaggacttgtgctttagtccaattggccattcccttcaccctggcattccataagatacccaaaaatacacatggccactgacaccagagagatttgacaaattcttttaatcccaatacatatgttaactcaattggagtccctagaggtgtgcctaatgaatttaggcctaaaaccaaatagctgctgggttttaggactcttctgatggtcaactattaataagaatgtgaa

SEQ ID NO: 1270 - DNA, 366 bp, synthetic construct
  misc_feature 1..366: note = Synthetic polypeptide
  source 1..366: mol_type = other DNA
atggcggcggccgcgctaaggttccccgttcagggcacagtgacttttgaagacgtggctgtgaaatttacccaggaggaatggaatctccttagtgaggctcagagatgcctgtaccgtgatgtgacgctggagaacctggcacttatgtcctccctgggttgttggtgtggagtggaagatgaggcggcaccttctaagcagagtatttatatacaaagagagactcagggaaagaaacagtagctccactcctgccggtccctcccctaggggagagggaagcagaggagaaaacagcagcataggtggctggcaaagacaaaggaaagaccagtagaagagaaagaaaccaaaaacagcaag

SEQ ID NO: 1271 - DNA, 1049 bp, synthetic construct; identical to SEQ ID NO: 224
  misc_feature 1..1049: note = Synthetic polypeptide
  source 1..1049: mol_type = other DNA

SEQ ID NO: 1272 - DNA, 1502 bp, synthetic construct
  misc_feature 1..1502: note = Synthetic polypeptide
  source 1..1502: mol_type = other DNA
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagagttaattttgagtggtcctgacctaatcaactgagacattttaaaagagtctggaagtcagagaccctctttcctgctagcctggaagaagcaagcctcaaaaagtctgcagctgcaaggaaatgaattttgccaataattatgtgcgcttggaagaagactcagcctaagatgagatctaagccctggctgacacctccattgcagctttgtgggaccttgagcggagaacccagttaagttctgcctggactcctgacccactaaaactgtgagaaaatgaatgtgtgttgttttaagccactaaatttatagttatttgttatgtagcagtagaaaacaaacaca

SEQ ID NO: 1273 - DNA, 2713 bp, synthetic construct
  misc_feature 1..2713: note = Synthetic polypeptide
  source 1..2713: mol_type = other DNA
atggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtcaggccggctccggcgtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgtgcctacaggggttgtggaaggagacgctgcccccggtctatgccctggaattgctgaccatcttcgcctgggagcagggctgtaagaaggatgctttcagcctagccgaaggcctccgaactgtcctgggcctgatccaacagcatcagcacctgtgtgttttctggactgtcaactatggcttcgaggaccctgcagttgggcagttcttgcagcggcagcttaagagacccaggcctgtgatcctggacccagctgaccccacatgggacctggggaatggggcagcctggcactgggatttgctagcccaggaggcagcatcctgctatgaccacccatgctttctgagggggatgggggacccagtgcagtcttggaaggggccgggccttccacgtgctggatgctcaggtttgggccaccccatccagctagaccctaaccagaagacccctgaaaacagcaagagcctcaatgctgtgtacccaagagcagggagcaaacctccctcatgcccagctcctggccccactggggcagccagcatcgtcccctctgtgccgggaatggccttggacctgtctcagatccccaccaaggagctggaccgcttcatccaggaccacctgaagccgagcccccagttccaggagcaggtgaaaaaggccattgacatcatcttgcgctgcctccatgagaactgtgttcacaaggcctcaagagtcagtaaagggggctcatttggccggggcacagacctaagggatggctgtgatgttgaactcatcatcttcctcaactgcttcacggactacaaggaccaggggccccgccgcgcagagatccttgatgagatgcgagcgcagctagaatcctggtggcaggaccaggtgcccagcctgagccttcagtttcctgagcagaatgtgcctgaggctctgcagttccagctggtgtccacagccctgaagagctggacggatgttagcctgctgcctgccttcgatgctgtggggcagctcagttctggcaccaaaccaaatccccaggtctactcgaggctcctcaccagtggctgccaggagggcgagcataaggcctgcttcgcagagctgcggaggaacttcatgaacattcgccctgtcaagctgaagaacctgattctgctggtgaagcactggtaccgccaggttgcggctcagaacaaaggaaaaggaccagcccctgcctctctgcccccagcctatgccctggagctcctcaccatctttgcctgggagcagggctgcaggcaggattgtttcaacatggcccaaggcttccggacggtgctggggctcgtgcaacagcatcagcagctctgtgtctactggacggtcaactatagcactgaggacccagccatgagaatgcaccttcttggccagcttcgaaaacccagacccctggtcctggaccccgctgatcccacctggaacgtgggccacggtagctgggagctgttggcccaggaagcagcagcgctggggatgcaggcctgctttctgagtagagacgggacatctgtgcagccctgggatgtgatgccagccctcctttaccaaaccccagctggggaccttgacaagttcatcagtgaatttctccagcccaaccgccagttcctggcccaggtgaacaaggccgttgataccatctgttcatttttgaaggaaaactgcttccggaattctcccatcaaagtgatcaaggtggtcaagggtggctcttcagccaaaggcacagctctgcgaggccgctcagatgccgacctcgtggtgttcctcagctgcttcagccagttcactgagcagggcaacaagcgggccgagatcatctccgagatccgagcccagctggaggcatgtcaacaggagcggcagttcgaggtcaagtttgaagtctccaaatgggagaatccccgcgtgctgagcttctcactgacatcccagacgatgctggaccagagtgtggactttgatgtgctgccagcctttgacgccctaggcactctgtgggctaacagtggcc

SEQ ID NO: 1274 - DNA, 228 bp, synthetic construct
  misc_feature 1..228: note = Synthetic polypeptide
  source 1..228: mol_type = other DNA
ataccatctgttcatttttgaaggaaaactgcttccggaattctcccatcaaagtgatcaaggtggtcaaggagcggcagttcgaggtcaagtttgaagtctccaaatgggagaatccccgcgtgctgagcttctcactgacatcccagacgatgctggaccagagtgtggactttgatgtgctgccagcctttgacgccctaggcactctgtgggctaacagtggcc

SEQ ID NO: 1275 - DNA, 592 bp, synthetic construct
  misc_feature 1..592: note = Synthetic polypeptide
  source 1..592: mol_type = other DNA
atgggccccggggacttccgccgctgcagagagagaatttcccaggggctccagggactcccaggtagagcggagctttggttcccacctcgtcccgcgtgcgacttcttcggggacggcaggagcacggacatccaggaggaggccctcgccgccagcccgctgctggaggacctcagacgacggctgacgcgcgccttccagtgggcggtgcagcgcgcgatctcgaggcgcgtgcaggaggcggcggcggcggcggcggcgcgggaggagcagagctggacgggcgttgaggccaccctggccaggctgcgggcggagctggtattttcacatgcaattgtaaagcttgcctatgctgcagccaccctgtgacctaggtgggaaatatagcggcactttgaagatgacaggacagaaagatgaaaagcagtgtcttcaatgacatcaatgagcttctgaccccaccctgcaactgcctacctatggctagtcttgttctgtgagacaataacaataataaaatccaattgtttgaggcacttttattggggtattcagtttcttgcacctgaaagcaccctaactgata

SEQ ID NO: 1276 - DNA, 1692 bp, synthetic construct; identical to SEQ ID NO: 1048
  misc_feature 1..1692: note = Synthetic polypeptide
  source 1..1692: mol_type = other DNA

SEQ ID NO: 1277 - DNA, 1695 bp, synthetic construct; identical to SEQ ID NO: 1049
  misc_feature 1..1695: note = Synthetic polypeptide
  source 1..1695: mol_type = other DNA

SEQ ID NO: 1278 - DNA, 466 bp, synthetic construct; identical to SEQ ID NO: 1050
  misc_feature 1..466: note = Synthetic polypeptide
  source 1..466: mol_type = other DNA

SEQ ID NO: 1279 - DNA, 669 bp, synthetic construct
  misc_feature 1..669: note = Synthetic polypeptide
  source 1..669: mol_type = other DNA
atgtccgagtttctcctcgccttactcactctctcgggattattgccgattgccagggtgctgaccgtgggagccgaccgagatcagcagttgtgtgatcctggtgaatttctttgccacgatcacgtgacttgtgtctcccagagctggctgtgtgatggggaccctgactgccctgatgattcagacgagtctttagatacctgtcccgaggaggtagaaatcaagtgccccttgaatcacattgcttgccttggtaccaacaaatgtgttcatttatcccagctgtgcaatggtgtcttggactgcccagatgggtatgacgaaggagtacattgtcaggggacatggatggagcaggaggccattatcctcagcaaactaacacaggaatggaaaaccaaataccgcatattctctcttataagtgggagctgcatgatgagaacacatggacacaatgggaggaacaacacacactggggcctgttggagggcgggaggtgggaggaaggagagcatcaggaagaatagttcatggatgctgggcttaatacctaagtgatgggatgatctttacagcaaaccaccatggcatacatttcctatgtaacaaacctgcacatcttgcacatgtatccctgaacttaaaagctggaaaaaaataaa

SEQ ID NO: 1280 - DNA, 528 bp, synthetic construct
  misc_feature 1..528: note = Synthetic polypeptide
  source 1..528: mol_type = other DNA
atgcagcggaccgggggcggggctccgaggcccgggcgcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaaccctgagagctgctcaagggtggggcctgtgtcttgtctt

SEQ ID NO: 1281 - DNA, 438 bp, synthetic construct
  misc_feature 1..438: note = Synthetic polypeptide
  source 1..438: mol_type = other DNA
atgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaaccctgagagctgctcaagggtggggcctgtgtcttgtctt

SEQ ID NO: 1282 - DNA, 728 bp, synthetic construct; identical to SEQ ID NO: 269
  misc_feature 1..728: note = Synthetic polypeptide
  source 1..728: mol_type = other DNA

SEQ ID NO: 1283 - DNA, 663 bp, synthetic construct; identical to SEQ ID NO: 271
  misc_feature 1..663: note = Synthetic polypeptide
  source 1..663: mol_type = other DNA

SEQ ID NO: 1284 - DNA, 1726 bp, synthetic construct
  misc_feature 1..1726: note = Synthetic polypeptide
  source 1..1726: mol_type = other DNA
atgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgaaaacgaaattgcacagtgcgaagtctttcatcagtgcgagcagtggggaaattattttctgcattctgggcatttgcacgccaaaggcaaagaagaaaaaatgtccaaatcattaaagaactacattactattaaggacatcattggaggaagtcactgcatatatggtgggaatagcaagagaactattggaattggaaatggatcctggagatgtgactgaactgctgcaacctcatgataaaagttgaacaaacgaggagttgcttcttatggatgagcaaagaaagtggtttcttgagatggaatctactcctggtgaagatgctgtggacattgttgaaatgacaacaaaggatttagactattgcataaatttagttgataaagcaatggcagggtttgagaggattggctccaattttgaaagacattctgccgtgggtaaaatgctatcaaacattggatgctacagagaaatctttcatgaaaggaagagtcaattgatggcacagacttcattattgtcttgttttaagaaattgccacagtaactcagccttcatcaaccactaccttgatcagtcagcagccataatattgaatcaaaaccttccaccagcaaaaagatgactcactgaaggctcatatgattatcatttttgttagcaataaaatattttttcattaaggtacgtacattgttctttcagacataatgctattatatacttaatagactgcagtataatagtgtaaacataacttttatatgcactgggaaaccagaaaatatgtgtgccttgctttattgtgatattcgctttattgtggtggtctggaaccaacccttcagtatgtctgaggtctgcctg

SEQ ID NO: 1285 - DNA, 807 bp, synthetic construct
  misc_feature 1..807: note = Synthetic polypeptide
  source 1..807: mol_type = other DNA
ggcatttgcacgccaaaggcaaagaagaaaaaatgtccaaatcattaaagaactacattactattaaggacatcattggaggaagtcactgcatatatggtgggaatagcaagagaactattggaattggaaatggatcctggagatgtgactgaactgctgcaacctcatgataaaagttgaacaaacgaggagttgcttcttatggatgagcaaagaaagtggtttcttgagatggaatctactcctggtgaagatgctgtggacattgttgaaatgacaacaaaggatttagactattgcataaatttagttgataaagcaatggcagggtttgagaggattggctccaattttgaaagacattctgccgtgggtaaaatgctatcaaacattggatgctacagagaaatctttcatgaaaggaagagtcaattgatggcacagacttcattattgtcttgttttaagaaattgccacagtaactcagccttcatcaaccactaccttgatcagtcagcagccataatattgaatcaaaaccttccaccagcaaaaagatgactcactgaaggctcatatgattatcatttttgttagcaataaaatattttttcattaaggtacgtacattgttctttcagacataatgctattatatacttaatagactgcagtataatagtgtaaacataacttttatatgcactgggaaaccagaaaatatgtgtgccttgctttattgtgatattcgctttattgtggtggtctggaaccaacccttcagtatgtctgaggtctgcctg

SEQ ID NO: 1286 - DNA, 992 bp, synthetic construct
  misc_feature 1..992: note = Synthetic polypeptide
  source 1..992: mol_type = other DNA
ctggggacccgggaggccgggctggcacatcgagtgctctgccatcgctagtatggtatttggaagtcaactggatatccattcaggtgggatagatttagcttttccacatcatgaaaacgaaattgcacagtgcgaagtctttcatcagtgcgagcagtggggaaattattttctgcattctgggcatttgcacgccaaaggcaaagaagaaaaaatgtccaaatcattaaagaactacattactattaaggacatcattggaggaagtcactgcatatatggtgggaatagcaagagaactattggaattggaaatggatcctggagatgtgactgaactgctgcaacctcatgataaaagttgaacaaacgaggagttgcttcttatggatgagcaaagaaagtggtttcttgagatggaatctactcctggtgaagatgctgtggacattgttgaaatgacaacaaaggatttagactattgcataaatttagttgataaagcaatggcagggtttgagaggattggctccaattttgaaagacattctgccgtgggtaaaatgctatcaaacattggatgctacagagaaatctttcatgaaaggaagagtcaattgatggcacagacttcattattgtcttgttttaagaaattgccacagtaactcagccttcatcaaccactaccttgatcagtcagcagccataatattgaatcaaaaccttccaccagcaaaaagatgactcactgaaggctcatatgattatcatttttgttagcaataaaatattttttcattaaggtacgtacattgttctttcagacataatgctattatatacttaatagactgcagtataatagtgtaaacataacttttatatgcactgggaaaccagaaaatatgtgtgccttgctttattgtgatattcgctttattgtggtggtctggaaccaacccttcagtatgtctgaggtctgcctg

SEQ ID NO: 1287 - DNA, 7808 bp, synthetic construct; identical to SEQ ID NO: 1143
  misc_feature 1..7808: note = Synthetic polypeptide
  source 1..7808: mol_type = other DNA

SEQ ID NO: 1288 - DNA, 1874 bp, synthetic construct; identical to SEQ ID NO: 1144
  misc_feature 1..1874: note = Synthetic polypeptide
  source 1..1874: mol_type = other DNA

SEQ ID NO: 1289 - DNA, 609 bp, synthetic construct; identical to SEQ ID NO: 249
  misc_feature 1..609: note = Synthetic polypeptide
  source 1..609: mol_type = other DNA

SEQ ID NO: 1290 - DNA, 738 bp, synthetic construct; identical to SEQ ID NO: 250
  misc_feature 1..738: note = Synthetic polypeptide
  source 1..738: mol_type = other DNA

SEQ ID NO: 1291 - DNA, 537 bp, synthetic construct; identical to SEQ ID NO: 251
  misc_feature 1..537: note = Synthetic polypeptide
  source 1..537: mol_type = other DNA

SEQ ID NO: 1292 - DNA, 684 bp, synthetic construct; identical to SEQ ID NO: 253
  misc_feature 1..684: note = Synthetic polypeptide
  source 1..684: mol_type = other DNA

SEQ ID NO: 1293 - DNA, 285 bp, synthetic construct; identical to SEQ ID NO: 255
  misc_feature 1..285: note = Synthetic polypeptide
  source 1..285: mol_type = other DNA

SEQ ID NO: 1294 - DNA, 552 bp, synthetic construct; identical to SEQ ID NO: 254
  misc_feature 1..552: note = Synthetic polypeptide
  source 1..552: mol_type = other DNA

SEQ ID NO: 1295 - DNA, 964 bp, synthetic construct
  misc_feature 1..964: note = Synthetic polypeptide
  source 1..964: mol_type = other DNA
atgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgtcacttcctcccatccactgtgctttcggcagttcattcgttcattaattcattcaacgaatattgaataacttttgatcaatgtcttcctccctccaagctgaaaacttgatggagggtaacatgatctgtctttgtttaccactgcatcttccgtgaatatacattgtaagtattgaacggatttttactaaatgaacaaat

SEQ ID NO: 1296 - DNA, 445 bp, synthetic construct
  misc_feature 1..445: note = Synthetic polypeptide
  source 1..445: mol_type = other DNA
atggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgtcacttcctcccatccactgtgctttcggcagttcattcgttcattaattcattcaacgaatattgaataacttttgatcaatgtcttcctccctccaagctgaaaacttgatggagggtaacatgatctgtctttgtttaccactgcatcttccgtgaatatacattgtaagtattgaacggatttttactaaatgaacaaat

SEQ ID NO: 1297 - DNA, 319 bp, synthetic construct
  misc_feature 1..319: note = Synthetic polypeptide
  source 1..319: mol_type = other DNA
cataacgactatatgtgtccagccaccaaccagtgcaccattgataaaaacaggaggaagagctgccaggcctgccggctccgtaaatgctacgaagtgggaatgatgaaaggtgtcacttcctcccatccactgtgctttcggcagttcattcgttcattaattcattcaacgaatattgaataacttttgatcaatgtcttcctccctccaagctgaaaacttgatggagggtaacatgatctgtctttgtttaccactgcatcttccgtgaatatacattgtaagtattgaacggatttttactaaatgaacaaat

SEQ ID NO: 1298 - DNA, 494 bp, synthetic construct
  misc_feature 1..494: note = Synthetic polypeptide
  source 1..494: mol_type = other DNA
atgccccctttcctgttgctggaagccgtctgtgttttcctgttttccagagtgcccccatctctccctctccaggaagtccatgtaagcaaagaaaccatcgggaagatttcagctgccagcaaaatgatgtggtgctcggctgcagtggacatcatgtttctgttagatgggtctaacagcgtcgggaaagggagctttgaaaggtccaagcactttgccatcacagtctgtgacggtctggacatcagccccgagagggtcagagtgggagcattccagttcagttccactcctcatctggaattccccttggattcattttcaacccaacaggaagtgaaggcaagaatcaagaggatggttttcaaatcccatttcttcaactagactgggagttctttaagggatgggatcgtggttatacttcctggtctccatttcactatcttccctctagtggatccacagtaaatactcacaggttgaaaaaa

SEQ ID NO: 1299 - DNA, 3628 bp, synthetic construct; identical to SEQ ID NO: 330
  misc_feature 1..3628: note = Synthetic polypeptide
  source 1..3628: mol_type = other DNA

SEQ ID NO: 1300 - DNA, 3127 bp, synthetic construct; identical to SEQ ID NO: 332
  misc_feature 1..3127: note = Synthetic polypeptide
  source 1..3127: mol_type = other DNA

SEQ ID NO: 1301 - DNA, 1158 bp, synthetic construct
  misc_feature 1..1158: note = Synthetic polypeptide
  source 1..1158: mol_type = other DNA
atgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaggtactgataagcaacctgagaaatgtggtggaggctcagtttgatagccgggttcgtgcaacaggacacagttatgagaagtacaacaagtgggaaacgatagaggcttggactcaacaagtcgccactgagaatccagccctcatctctcgcagtgttatcggaaccacatttgagggacgcgctatttacctcctgaaggttggcaaagctggacaaaataagcctgccattttcatggactgtggtttccatgccagagagtggatttctcctgcattctgccagtggtttgtaagagaggctgttcgtacctatggacgtgagatccaagtgacagagcttctcgacaagttagacttttatgtcctgcctgtgctcaatattgatggctacatctacacctggaccaagagccgattttggagaaagactcgctccacccatactggatctagctgcattggcacagaccccaacagaaattttgatgctggttggtgtgaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttgatgacatttggcaatgtttgggagacatctttggttgtcataactgtcgagctctactggcatctagtgagtagaggccaagggatgctgataaacatcctacaatgcacagaacagccctcccatccccaacaaattatccagcccaaaacgtcaagagtgccaaggttgagaaac

SEQ ID NO: 1302 - DNA, 150 bp, synthetic construct
  misc_feature 1..150: note = Synthetic polypeptide
  source 1..150: mol_type = other DNA
atggtcttgctgacttcaagaatgaagccgctgacctcgcgcataattagcatcatcattattctggctggagcaattgcactcatcattggctttggtatttcagtctcaggtgtgtctttatcagcagcatgaaaatggactaatata

SEQ ID NO: 1303 - DNA, 141 bp, synthetic construct
  misc_feature 1..141: note = Synthetic polypeptide
  source 1..141: mol_type = other DNA
atggcttccctggggcagatcctcttctggagcataattagcatcatcattattctggctggagcaattgcactcatcattggctttggtatttcagtctcaggtgtgtctttatcagcagcatgaaaatggactaatata

SEQ ID NO: 1304 - DNA, 517 bp, synthetic construct
  misc_feature 1..517: note = Synthetic polypeptide
  source 1..517: mol_type = other DNA
atgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgttctaccctagacctactgaatctgaaactgggagagtaagactgaattttcagctctccaaatgattctcctgtaacccaaagtttgagaaccactg

SEQ ID NO: 1305 - DNA, 337 bp, synthetic construct
  misc_feature 1..337: note = Synthetic polypeptide
  source 1..337: mol_type = other DNA
atggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgttctaccctagacctactgaatctgaaactgggagagtaagactgaattttcagctctccaaatgattctcctgtaacccaaagtttgagaaccactg

SEQ ID NO: 1306 - DNA, 775 bp, synthetic construct; identical to SEQ ID NO: 215
  misc_feature 1..775: note = Synthetic polypeptide
  source 1..775: mol_type = other DNA

SEQ ID NO: 1307 - DNA, 1827 bp, synthetic construct
  misc_feature 1..1827: note = Synthetic polypeptide
  source 1..1827: mol_type = other DNA
cctcgggatcatagtctcaacgcatctcaagggcattttatgttcattctgaagaaaagcagcagcttgtggcaagttgctaagcttcagagcccaactttcagccagacaggacctggatgcatactttccttctggttctataactatggcctgtcagtgggagcagctgagctgcagctacatatggaaaattctcatgactcaacagtgatttggagagtattatacaatcagggcaaacaatggttggaggcaaccattcagctagggcgcctttcgcagcccttccatttgtcactagataaagtcagtctgggcatttatgatggggtctcagctattgatgacatccgatttgaaaattgtactctccctcttcctgctgagagctgtgaagggctggatcatttctggtgtcgccacaccagggcttgcatagaaaagcttcggttatgtgatctggtggatgactgtggtgatcgtactgatgaagtcaactgtgcacctgagctgcagtgtaactttgaaactggaatctgtaactgggaacaagatgcaaaagatgactttgattggaccaggagccagggtccaactccaacacttaacacagggccaatgaaagataacactctgggcacagctaaaggacactatctctacatagaatcttcagagccacaggcttttcaagacagtgctgccttactcagcccaatccttaatgccactgatacaaaaggctgcaccttccgcttctattaccacatgtttggaaagcgcatttataggttggcaatctaccaacgaatctggagtgactcaaggggacagctgctgtggcagatatttgggaatcaaggcaacagatggattaggaaacacctcaacatttccagcaggcagccctttcagatattggtggaggcttcagtgggagatggcttcactggagatattgcgattgatgatctgtcatttatggactgcaccctctaccctggtaatttgccagcagacctcccaactccaccagaaacgtcagttcctgtaacattacctccacacaactgcacagacaatgaatttatctgcaggtctgatggtcactgcattgaaaaaatgcagaaatgtgattttaaatatgactgccctgacaaatcagatgaagcatcctgtgttatggaagtttgcagctttgagaaaagaagcctgtgtaaatggtatcaaccaatcccagtacatttgcttcaagattcaaacacattcaggtgggggcttgggaacgggatcagcattcatcatggggaagaaaaccacaggccatcagtggatcatacacaaaaatctagaagaaatggatacattcctcgacacatacactctcccaagactaaaccaggaagaagttgaatctctgaatagaccaataacaggagctgaaattgtgacaataatcaatagtttaccaaccaaaaagagtccaggaccagatggattcacagccgaattctaccagaggtacaaggaggaactggtaccattccttctgaaactattccaatcaatagaaaaggagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaataca

SEQ ID NO: 1308 - DNA, 1788 bp, synthetic construct
  misc_feature 1..1788: note = Synthetic polypeptide
  source 1..1788: mol_type = other DNA
atgttcattctgaagaaaagcagcagcttgtggcaagttgctaagcttcagagcccaactttcagccagacaggacctggatgcatactttccttctggttctataactatggcctgtcagtgggagcagctgagctgcagctacatatggaaaattctcatgactcaacagtgatttggagagtattatacaatcagggcaaacaatggttggaggcaaccattcagctagggcgcctttcgcagcccttccatttgtcactagataaagtcagtctgggcatttatgatggggtctcagctattgatgacatccgatttgaaaattgtactctccctcttcctgctgagagctgtgaagggctggatcatttctggtgtcgccacaccagggcttgcatagaaaagcttcggttatgtgatctggtggatgactgtggtgatcgtactgatgaagtcaactgtgcacctgagctgcagtgtaactttgaaactggaatctgtaactgggaacaagatgcaaaagatgactttgattggaccaggagccagggtccaactccaacacttaacacagggccaatgaaagataacactctgggcacagctaaaggacactatctctacatagaatcttcagagccacaggcttttcaagacagtgctgccttactcagcccaatccttaatgccactgatacaaaaggctgcaccttccgcttctattaccacatgtttggaaagcgcatttataggttggcaatctaccaacgaatctggagtgactcaaggggacagctgctgtggcagatatttgggaatcaaggcaacagatggattaggaaacacctcaacatttccagcaggcagccctttcagatattggtggaggcttcagtgggagatggcttcactggagatattgcgattgatgatctgtcatttatggactgcaccctctaccctggtaatttgccagcagacctcccaactccaccagaaacgtcagttcctgtaacattacctccacacaactgcacagacaatgaatttatctgcaggtctgatggtcactgcattgaaaaaatgcagaaatgtgattttaaatatgactgccctgacaaatcagatgaagcatcctgtgttatggaagtttgcagctttgagaaaagaagcctgtgtaaatggtatcaaccaatcccagtacatttgcttcaagattcaaacacattcaggtgggggcttgggaacgggatcagcattcatcatggggaagaaaaccacaggccatcagtggatcatacacaaaaatctagaagaaatggatacattcctcgacacatacactctcccaagactaaaccaggaagaagttgaatctctgaatagaccaataacaggagctgaaattgtgacaataatcaatagtttaccaaccaaaaagagtccaggaccagatggattcacagccgaattctaccagaggtacaaggaggaactggtaccattccttctgaaactattccaatcaatagaaaaggagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaataca

SEQ ID NO: 1309 - DNA, 586 bp, synthetic construct; identical to SEQ ID NO: 401
  misc_feature 1..586: note = Synthetic polypeptide
  source 1..586: mol_type = other DNA

SEQ ID NO: 1310 - DNA, 829 bp, synthetic construct; identical to SEQ ID NO: 402
  misc_feature 1..829: note = Synthetic polypeptide
  source 1..829: mol_type = other DNA

SEQ ID NO: 1311 - DNA, 1060 bp, synthetic construct; identical to SEQ ID NO: 403
  misc_feature 1..1060: note = Synthetic polypeptide
  source 1..1060: mol_type = other DNA

SEQ ID NO: 1312 - DNA, 730 bp, synthetic construct; identical to SEQ ID NO: 406
  misc_feature 1..730: note = Synthetic polypeptide
  source 1..730: mol_type = other DNA

SEQ ID NO: 1313 - DNA, 496 bp, synthetic construct; identical to SEQ ID NO: 408
  misc_feature 1..496: note = Synthetic polypeptide
  source 1..496: mol_type = other DNA

SEQ ID NO: 1314 - DNA, 1491 bp, synthetic construct
  misc_feature 1..1491: note = Synthetic polypeptide
  source 1..1491: mol_type = other DNA
aacaacctgcagcagcccacgtggggcgcggcgctgaccgccttcgcgcgcctgctgcagccagcctaccgggacggcatccgcgcgccccgcgggctcggccttcctgtgggctcccgccagcccctcccgccgccccggctggtcgccacagtgtgggcgcgcgcggcggccgtcacccccgaccacagctacacgcgcatgctcatgcactggggctggtttctagagcacgacttggaccacacagtgcctgcgctgagcacagcccgcttctcggatgggcggccgtgcagctccgtctgcaccaacgaccctccttgtttccccatgaacacccggcacgccgacccccggggcacccacgcgccctgcatgctcttcgcgcgctccagccccgcgtgtgccagcggccgtccctctgcgacggtggattcagtctatgcacgagagcagatcaaccagcaaacagcctacatcgatggctccaacgtttacgggagctcggagcgggaatcccaggctctcagagacccttcggtgcctcggggtctcctgaagacaggctttccttggcctccctccggaaagcccttattgcccttttctacaggcccacccaccgagtgcgcgcgacaggagcaggagagcccctgtttcctggccggggaccaccgggccaacgagcatctggctctggccgccatgcacaccctgtggttccgggaacacaacaggatggccacggagctgtccgccctgaacccccactgggagggaaacacggtttaccaggaagccaggaagatcgtgggcgcggagctgcagcacatcacctacagccactggctgcctaaggtcctgggggaccctggcactaggatgctgaggggttaccgaggctacaaccccaacgtgaatgcaggcatcattaactcttttgctactgcagcctttagatttggccacacattaatcaatcctattctttaccgactgaatgccaccttaggtgaaatttccgaaggccaccttccgttccataaagcgctcttttcaccgtccagaataatcaaggaaggtgggatagacccggttctccgggggctgtttggcgtggctgctaaatggcgggcaccctcctaccttctcagtcctgagctgacccagaggctcttctccgcggcttattctgcggccgtggattcggctgccaccatcattcaaaggggtagagaccacgggatcccaccatatgttgacttcagagttttctgtaatttgacttcagttaagaactttgaggatcttcaaaatgaaattaaagattcagagattagacaaaaactgagaaagttgtacggctctccaggtgacattgacctctggcccgcccttatggttgaagacctgattcctggtacaagagtgggaccaacacttatgtgcctgtttgttacccagtttcagcggctaagagatggagatagg

SEQ ID NO: 1315 - DNA, 3693 bp, synthetic construct
  misc_feature 1..3693: note = Synthetic polypeptide
  source 1..3693: mol_type = other DNA
atggagcccagactgttctgctggaccactctctttctcctggccgggtggtgcctgccagggttgccctgccccagccggtgcctttgctttaagagcaccgtccgctgcatgcacttgatgctggaccacattcctcaggtaccacagcagaccacagttctagacttgaggtttaacagaataagagaaattccagggagcgccttcaagaaactcaagaatttgaacacacttctgctgaacaacaaccacatcagaaagatttccagaaatgcttttgaaggacttgaaaatttgctatatctgtacctgtataagaatgaaatccatgcactagataagcaaacatttaaaggactcatatctttggaacatctgtatattcatttcaaccaactagaaatgctacagccagagacctttggagaccttctgagattagagcgactatttttgcataacaacaaattatctaaaattccagctgggagcttttctaatctggattcattaaaaagattgcgtctggattccaacgccctggtttgtgactgtgatctgatgtggctgggggagcttttacaaggctttgcccaacacggccacacccaggctgcggctacctgcgaatatcccaggagactccatgggcgtgcagttgcttcagtaacagtagaggaattcaattgccagagcccccgaattacttttgagccgcaggatgtggaggtaccatcaggaaataccgtctacttcacctgccgggcggaaggaaaccccaaacctgagattatttggatacacaacaaccactcattggatttggaagatgatactcgacttaatgtgtttgatgatggcacactcatgatccgaaacaccagagagtcagaccaaggtgtctatcagtgcatggccagaaattccgctggggaagccaagacacagagtgccatgctcagatactccagtcttccagccaaaccaagctttgtaatccagcctcaggacacagaggttttaattggcaccagcacaactttggaatgtatggccacaggccacccacaccctcttatcacttggaccagggacaatggattggagctggatggatccaggcacgtggcaacgtccagtggactttacttacagaacatcacacaacgggatcatggtcgatttacctgtcatgccaacaatagccacggcactgttcaagctgcagcaaacataattgtacaagctcctccacaatttacagtaacccccaaggatcaagtggtgctggaagaacatgctgtagagtggctctgtgaagctgacggcaacccacctcctgttattgtctggacaaaaacaggagggcagctccctgtggaaggccagcatacagttctctcctctggcactttgagaattgaccgtgcagcacagcacgatcaaggccaatatgaatgtcaagcagtcagttcgttgggggtgaaaaaggtgtctgtgcagctgactgtaaaacccaaagctcttgcagtgtttactcaacttcctcaggatacaagtgtcgaggttggaaagaatataaacatttcatgtcatgctcaaggagaaccacagcccataattacttggaataaggaaggtgtgcagattactgagagtggtaaattccatgtggatgatgaaggcacgctgactatctacgacgcagggttccctgaccagggaagatatgaatgtgtggctcggaattcttttggccttgctgtgaccaacatgtttcttacagtcacggctatacagggtagacaagctggcgatgactttgttgaatcttccattcttgatgctgtacagagagttgacagtgcaattaactccacacgaagacatttgttttcacaaaaacctcacacctccagtgacctgctggctcaatttcattacccgcgtgacccactgattgtggaaatggcaagagcaggggagatttttgagcacacgctgcagctgatacgggaacgtgtgaagcaggggctcactgtggacttggaaggcaaagaattccggtacaatgacttggtgtccccgcgctccctcagcctcatcgccaatttatctggatgcacagctcgcaggcctctgccaaactgctccaaccggtgtttccatgcgaagtaccgcgcccacgacggcacgtgcaacaacctgcagcagcccacgtggggcgcggcgctgaccgccttcgcgcgcctgctgcagccagcctaccgggacggcatccgcgcgccccgcgggctcggccttcctgtgggctcccgccagcccctcccgccgccccggctggtcgccacagtgtgggcgcgcgcggcggccgtcacccccgaccacagctacacgcgcatgctcatgcactggggctggtttctagagcacgacttggaccacacagtgcctgcgctgagcacagcccgcttctcggatgggcggccgtgcagctccgtctgcaccaacgaccctccttgtttccccatgaacacccggcacgccgacccccggggcacccacgcgccctgcatgctcttcgcgcgctccagccccgcgtgtgccagcggccgtccctctgcgacggtggattcagtctatgcacgagagcagatcaaccagcaaacagcctacatcgatggctccaacgtttacgggagctcggagcgggaatcccaggctctcagagacccttcggtgcctcggggtctcctgaagacaggctttccttggcctccctccggaaagcccttattgcccttttctacaggcccacccaccgagtgcgcgcgacaggagcaggagagcccctgtttcctggccggggaccaccgggccaacgagcatctggctctggccgccatgcacaccctgtggttccgggaacacaacaggatggccacggagctgtccgccctgaacccccactgggagggaaacacggtttaccaggaagccaggaagatcgtgggcgcggagctgcagcacatcacctacagccactggctgcctaaggtcctgggggaccctggcactaggatgctgaggggttaccgaggctacaaccccaacgtgaatgcaggcatcattaactcttttgctactgcagcctttagatttggccacacattaatcaatcctattctttaccgactgaatgccaccttaggtgaaatttccgaaggccaccttccgttccataaagcgctcttttcaccgtccagaataatcaaggaaggtgggatagacccggttctccgggggctgtttggcgtggctgctaaatggcgggcaccctcctaccttctcagtcctgagctgacccagaggctcttctccgcggcttattctgcggccgtggattcggctgccaccatcattcaaaggggtagagaccacgggatcccaccatatgttgacttcagagttttctgtaatttgacttcagttaagaactttgaggatcttcaaaatgaaattaaagattcagagattagacaaaaactgagaaagttgtacggctctccaggtgacattgacctctggcccgcccttatggttgaagacctgattcctggtacaagagtgggaccaacacttatgtgcctgtttgttacccagtttcagcggctaagagatggagatagg

SEQ ID NO: 1316 - DNA, 3093 bp, synthetic construct; identical to SEQ ID NO: 341
  misc_feature 1..3093: note = Synthetic polypeptide
  source 1..3093: mol_type = other DNA

SEQ ID NO: 1317 - DNA, 2979 bp, synthetic construct; identical to SEQ ID NO: 342
  misc_feature 1..2979: note = Synthetic polypeptide
  source 1..2979: mol_type = other DNA

SEQ ID NO: 1318 - DNA, 3078 bp, synthetic construct; identical to SEQ ID NO: 343
  misc_feature 1..3078: note = Synthetic polypeptide
  source 1..3078: mol_type = other DNA

SEQ ID NO: 1319 - DNA, 3072 bp, synthetic construct; identical to SEQ ID NO: 346
  misc_feature 1..3072: note = Synthetic polypeptide
  source 1..3072: mol_type = other DNA

SEQ ID NO: 1320 - DNA, 1935 bp, synthetic construct; identical to SEQ ID NO: 347
  misc_feature 1..1935: note = Synthetic polypeptide
  source 1..1935: mol_type = other DNA

SEQ ID NO: 1321 - DNA, 1096 bp, synthetic construct; identical to SEQ ID NO: 348
  misc_feature 1..1096: note = Synthetic polypeptide
  source 1..1096: mol_type = other DNA

SEQ ID NO: 1322 - DNA, 902 bp, synthetic construct; identical to SEQ ID NO: 349
  misc_feature 1..902: note = Synthetic polypeptide
  source 1..902: mol_type = other DNA

SEQ ID NO: 1323 - DNA, 874 bp, synthetic construct; identical to SEQ ID NO: 350
  misc_feature 1..874: note = Synthetic polypeptide
  source 1..874: mol_type = other DNA

SEQ ID NO: 1324 - DNA, 453 bp, synthetic construct
  misc_feature 1..453: note = Synthetic polypeptide
  source 1..453: mol_type = other DNA
atgcgcttgctccagctcctgttcagggccagccctgccaccctgctcctggttctctgcctgcagttgggggccaacaaagctcaggacaacacgttggatgaagcaaactaccattctggaaagacccagatggcaagaaattgaaggtggcctctaaccaacagctagcaaggaactgaggccctcagtccaaaacccacagggaactgaatgctgccaacaaccatgtgggcttggaaacatgcccttccatcattaagccttcagaaagaacgtatccctggcaaacacctggattgtagcctgtgaaaaatgctgaagcagaggacccagttaatctgtgcccaaaattcttgaccccagaaactgaaagataataaatgtgtgtgcatgttttttaaggcactgcatttgtggtaattcattatgcaccaatagataactaataca

SEQ ID NO: 1325 - DNA, 970 bp, synthetic construct
  misc_feature 1..970: note = Synthetic polypeptide
  source 1..970: mol_type = other DNA
atgtttccctttgggccccatagccctggaggggacggatcggccggagccggggctgaggagccgacgccccacgaggggcaggcagcagccaccgggccgccctcgccactacatcccggggctgatgcgacccatccccctccacccgcccgaagccctcgccgccccggcgccccatcgctgtccccggccccgcgctccggagagctagggctgcctggagctccggagtcctcaactgcctccgccccgggagagccgtcacctccctcccctccgtgccggcggcccgggccagactgcagggccaagagccggggccgacacggcctcggcgcgggcctgggcggccctggcgctaggctgttcgggtggctgaaagagcgcagcctgggccgcgggctgttcgtggacccggcgcgggacaattttcgcaccatgactagcctctacggttccatccaccccgcggactcggtgtacctcagcacccgcacccacggcgccgtcttcaacctcgagtactcgcccgacgggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggctgaggcaggagaatcgcttaaacccaggaggcggagttcacagtaagccaagatcgcgccattgcactctagcctgggcaacaagagtgaaactccgtctcaaaaaaaaaaaaaaaa

SEQ ID NO: 1326 - DNA, 2849 bp, synthetic construct
  misc_feature 1..2849: note = Synthetic polypeptide
  source 1..2849: mol_type = other DNA
atgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcaggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaagggttatgggaggatgaggtg

SEQ ID NO: 1327 - DNA, 1925 bp, synthetic construct
  misc_feature 1..1925: note = Synthetic polypeptide
  source 1..1925: mol_type = other DNA
atgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcaggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaagggttatgggaggatgaggtg

SEQ ID NO: 1328 - DNA, 2729 bp, synthetic construct
  misc_feature 1..2729: note = Synthetic polypeptide
  source 1..2729: mol_type = other DNA
atgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcaggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaagggttatgggaggatgaggtg

SEQ ID NO: 1329 - DNA, 2549 bp, synthetic construct
  misc_feature 1..2549: note = Synthetic polypeptide
  source 1..2549: mol_type = other DNA
atgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcaggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaagggttatgggaggatgaggtg

SEQ ID NO: 1330 - DNA, 2361 bp, synthetic construct
  misc_feature 1..2361: note = Synthetic polypeptide
  source 1..2361: mol_type = other DNA
atggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccagctgagagaagtgaggaagctgcagaagaaaacttggatgctagcagaggttggttcatgaggtataagaaagaagccatctccatagcatggaagtgcaaggtgaagcagcaagtgctgctggagaagctgcagtgagttttccagatcccgctcagatcactaatgaaggtggctgcatgtaaacagaagattttcagtgtagatgaaacagccttctattggaagaagatgccatctaagacttttcatagctagagagaaggcactgcttcaaagcttcacacagctggctgaatcttgttagggcccaatgcagctggtgacttgaagttgaaaccagtgttcggtgatgattctggaaatcttagggcccttaagaattatgctgaatctcctctgcctgtgctctataaatggaacaacaaagcctggatgacagcacatctgtttacagcatggtttactgaatattttaagccctctttgaggtctgttgttcagaaaaatttcttggaaaatatgattgttcatggacaacggacctcatcacccaagagctctaatggagatgtgcaaggagatgctgttttcatgcctgcgaacacaacatccattctgcagcccatggataaaggagtcattttgattttaaagtctcactatttaagaaataaattttgtaaggctatgagctaccatagatagtgattcctccaatgaatctgcagagtcaattgaaaaccttctgggaagaatttaccattctaggtgctattaggaatattcgtgattcataggaggaggtcagaataccaacattaacaggagtttggaagaagttgattccagccctcatggatgactttgaggggttcaagactttagaggaagaaggaactgctgctgtggtggaaacagcaaggaaactagaattagaagtggagcctgaagatgtgaccgaactgctgcatcaagacaatacttgatcagatgaggagtcgcttcttatggatgagcaaaagaagtggtttctcaagatggaatctaatcctggcaacgacgttgtgaaatgacattgttgaaatgacaacaaaggattttaaatattgtaaatattacctgaacttagttgataaagcagcaggatatatgagaggattgactccagttttgaaaagttttactgtgagtaaaatgctatcagacagcatcacatgctacagagaaatcttttattgttgtcttattttaagaaattgccacagccatctcatccttcagcacccagcaccctaccctgatcagtcagcagccatcaacatggaggccagaccctccaccagcagaaagattacgacttgctgaaggctcagatgatcattagcattttttagcaataaagtattttttaattgaggtatgtacattgtttttttagatatgatgctattgcatactagactacaatatagtgtaaacataatttatatgtgctgggaaaaagaaaagtcgtgtgacttgcttaattgtgataaaattgctttactgaaccttccatatctgcaaggtattcctg

SEQ ID NO: 1331 - DNA, 2160 bp, synthetic construct
  misc_feature 1..2160: note = Synthetic polypeptide
  source 1..2160: mol_type = other DNA
atggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacaggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccagctgagagaagtgaggaagctgcagaagaaaacttggatgctagcagaggttggttcatgaggtataagaaagaagccatctccatagcatggaagtgcaaggtgaagcagcaagtgctgctggagaagctgcagtgagttttccagatcccgctcagatcactaatgaaggtggctgcatgtaaacagaagattttcagtgtagatgaaacagccttctattggaagaagatgccatctaagacttttcatagctagagagaaggcactgcttcaaagcttcacacagctggctgaatcttgttagggcccaatgcagctggtgacttgaagttgaaaccagtgttcggtgatgattctggaaatcttagggcccttaagaattatgctgaatctcctctgcctgtgctctataaatggaacaacaaagcctggatgacagcacatctgtttacagcatggtttactgaatattttaagccctctttgaggtctgttgttcagaaaaatttcttggaaaatatgattgttcatggacaacggacctcatcacccaagagctctaatggagatgtgcaaggagatgctgttttcatgcctgcgaacacaacatccattctgcagcccatggataaaggagtcattttgattttaaagtctcactatttaagaaataaattttgtaaggctatgagctaccatagatagtgattcctccaatgaatctgcagagtcaattgaaaaccttctgggaagaatttaccattctaggtgctattaggaatattcgtgattcataggaggaggtcagaataccaacattaacaggagtttggaagaagttgattccagccctcatggatgactttgaggggttcaagactttagaggaagaaggaactgctgctgtggtggaaacagcaaggaaactagaattagaagtggagcctgaagatgtgaccgaactgctgcatcaagacaatacttgatcagatgaggagtcgcttcttatggatgagcaaaagaagtggtttctcaagatggaatctaatcctggcaacgacgttgtgaaatgacattgttgaaatgacaacaaaggattttaaatattgtaaatattacctgaacttagttgataaagcagcaggatatatgagaggattgactccagttttgaaaagttttactgtgagtaaaatgctatcagacagcatcacatgctacagagaaatcttttattgttgtcttattttaagaaattgccacagccatctcatccttcagcacccagcaccctaccctgatcagtcagcagccatcaacatggaggccagaccctccaccagcagaaagattacgacttgctgaaggctcagatgatcattagcattttttagcaataaagtattttttaattgaggtatgtacattgtttttttagatatgatgctattgcatactagactacaatatagtgtaaacataatttatatgtgctgggaaaaagaaaagtcgtgtgacttgcttaattgtgataaaattgctttactgaaccttccatatctgcaaggtattcctg

SEQ ID NO: 1332 - DNA, 1908 bp, synthetic construct
  misc_feature 1..1908: note = Synthetic polypeptide
  source 1..1908: mol_type = other DNA
atgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccagctgagagaagtgaggaagctgcagaagaaaacttggatgctagcagaggttggttcatgaggtataagaaagaagccatctccatagcatggaagtgcaaggtgaagcagcaagtgctgctggagaagctgcagtgagttttccagatcccgctcagatcactaatgaaggtggctgcatgtaaacagaagattttcagtgtagatgaaacagccttctattggaagaagatgccatctaagacttttcatagctagagagaaggcactgcttcaaagcttcacacagctggctgaatcttgttagggcccaatgcagctggtgacttgaagttgaaaccagtgttcggtgatgattctggaaatcttagggcccttaagaattatgctgaatctcctctgcctgtgctctataaatggaacaacaaagcctggatgacagcacatctgtttacagcatggtttactgaatattttaagccctctttgaggtctgttgttcagaaaaatttcttggaaaatatgattgttcatggacaacggacctcatcacccaagagctctaatggagatgtgcaaggagatgctgttttcatgcctgcgaacacaacatccattctgcagcccatggataaaggagtcattttgattttaaagtctcactatttaagaaataaattttgtaaggctatgagctaccatagatagtgattcctccaatgaatctgcagagtcaattgaaaaccttctgggaagaatttaccattctaggtgctattaggaatattcgtgattcataggaggaggtcagaataccaacattaacaggagtttggaagaagttgattccagccctcatggatgactttgaggggttcaagactttagaggaagaaggaactgctgctgtggtggaaacagcaaggaaactagaattagaagtggagcctgaagatgtgaccgaactgctgcatcaagacaatacttgatcagatgaggagtcgcttcttatggatgagcaaaagaagtggtttctcaagatggaatctaatcctggcaacgacgttgtgaaatgacattgttgaaatgacaacaaaggattttaaatattgtaaatattacctgaacttagttgataaagcagcaggatatatgagaggattgactccagttttgaaaagttttactgtgagtaaaatgctatcagacagcatcacatgctacagagaaatcttttattgttgtcttattttaagaaattgccacagccatctcatccttcagcacccagcaccctaccctgatcagtcagcagccatcaacatggaggccagaccctccaccagcagaaagattacgacttgctgaaggctcagatgatcattagcattttttagcaataaagtattttttaattgaggtatgtacattgtttttttagatatgatgctattgcatactagactacaatatagtgtaaacataatttatatgtgctgggaaaaagaaaagtcgtgtgacttgcttaattgtgataaaattgctttactgaaccttccatatctgcaaggtattcctg

SEQ ID NO: 1333 - DNA, 2175 bp, synthetic construct
  misc_feature 1..2175: note = Synthetic polypeptide
  source 1..2175: mol_type = other DNA
atgtctgttttcagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccagctgagagaagtgaggaagctgcagaagaaaacttggatgctagcagaggttggttcatgaggtataagaaagaagccatctccatagcatggaagtgcaaggtgaagcagcaagtgctgctggagaagctgcagtgagttttccagatcccgctcagatcactaatgaaggtggctgcatgtaaacagaagattttcagtgtagatgaaacagccttctattggaagaagatgccatctaagacttttcatagctagagagaaggcactgcttcaaagcttcacacagctggctgaatcttgttagggcccaatgcagctggtgacttgaagttgaaaccagtgttcggtgatgattctggaaatcttagggcccttaagaattatgctgaatctcctctgcctgtgctctataaatggaacaacaaagcctggatgacagcacatctgtttacagcatggtttactgaatattttaagccctctttgaggtctgttgttcagaaaaatttcttggaaaatatgattgttcatggacaacggacctcatcacccaagagctctaatggagatgtgcaaggagatgctgttttcatgcctgcgaacacaacatccattctgcagcccatggataaaggagtcattttgattttaaagtctcactatttaagaaataaattttgtaaggctatgagctaccatagatagtgattcctccaatgaatctgcagagtcaattgaaaaccttctgggaagaatttaccattctaggtgctattaggaatattcgtgattcataggaggaggtcagaataccaacattaacaggagtttggaagaagttgattccagccctcatggatgactttgaggggttcaagactttagaggaagaaggaactgctgctgtggtggaaacagcaaggaaactagaattagaagtggagcctgaagatgtgaccgaactgctgcatcaagacaatacttgatcagatgaggagtcgcttcttatggatgagcaaaagaagtggtttctcaagatggaatctaatcctggcaacgacgttgtgaaatgacattgttgaaatgacaacaaaggattttaaatattgtaaatattacctgaacttagttgataaagcagcaggatatatgagaggattgactccagttttgaaaagttttactgtgagtaaaatgctatcagacagcatcacatgctacagagaaatcttttattgttgtcttattttaagaaattgccacagccatctcatccttcagcacccagcaccctaccctgatcagtcagcagccatcaacatggaggccagaccctccaccagcagaaagattacgacttgctgaaggctcagatgatcattagcattttttagcaataaagtattttttaattgaggtatgtacattgtttttttagatatgatgctattgcatactagactacaatatagtgtaaacataatttatatgtgctgggaaaaagaaaagtcgtgtgacttgcttaattgtgataaaattgctttactgaaccttccatatctgcaaggtattcctg

SEQ ID NO: 1334 - DNA, 712 bp, synthetic construct; identical to SEQ ID NO: 1187
  misc_feature 1..712: note = Synthetic polypeptide
  source 1..712: mol_type = other DNA

SEQ ID NO: 1335 - DNA, 721 bp, synthetic construct; identical to SEQ ID NO: 414
  misc_feature 1..721: note = Synthetic polypeptide
  source 1..721: mol_type = other DNA

SEQ ID NO: 1336 - DNA, 1155 bp, synthetic construct
  misc_feature 1..1155: note = Synthetic polypeptide
  source 1..1155: mol_type = other DNA
atgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacgaccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaaacccactcctaagaatctaccctaaagatacacctccaagaatatgaaactacgtagacacacaaggtaatccattacaacattgtaattgcaaaatattggaggcaacctaaatgcccatatgtgggagagtggatgagtaagctatagtgtagccacaccatggattagtatatagccatcaaaaagagtgggaagatctctgtgaactcatttagaggagttttcaggatatactgttaaatgaaaaaagctaaatacaaatgagtatctgtagtatactgtcactgatgtaaaaaggaaggagatataagaaaatacacatatatccacttacttgtgcagaagatacttggaaggataaaacaggaccaaagaagacagattacctagagagggtatgtggcaagggagggaaggagggagtaggggtggggaacaagggtgaggaggaagtgacagttgtctatacaagtctacc

SEQ ID NO: 1337 - DNA, 1176 bp, synthetic construct
  misc_feature 1..1176: note = Synthetic polypeptide
  source 1..1176: mol_type = other DNA
atgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacgaccctggcactgaacttcggctctacgttgatgaagaagaagtctgatcctgagggtcccgcgctgctcttccctgagagtgaactttccatccggataggtagagctgggcttctttcagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaaacccactcctaagaatctaccctaaagatacacctccaagaatatgaaactacgtagacacacaaggtaatccattacaacattgtaattgcaaaatattggaggcaacctaaatgcccatatgtgggagagtggatgagtaagctatagtgtagccacaccatggattagtatatagccatcaaaaagagtgggaagatctctgtgaactcatttagaggagttttcaggatatactgttaaatgaaaaaagctaaatacaaatgagtatctgtagtatactgtcactgatgtaaaaaggaaggagatataagaaaatacacatatatccacttacttgtgcagaagatacttggaaggataaaacaggaccaaagaagacagattacctagagagggtatgtggcaagggagggaaggagggagtaggggtggggaacaagggtgaggaggaagtgacagttgtctatacaagtctacc

SEQ ID NO: 1338 - DNA, 903 bp, synthetic construct
  misc_feature 1..903: note = Synthetic polypeptide
  source 1..903: mol_type = other DNA
atgactgtgaggcctccccagccatgtggaactggtgcagcagaagacccccagacgaccctggcactgaacttcggctctacgttgatgaagaagaagtctgatcctgagggtcccgcgctgctcttccctgagagtgaactttccatccggataggtagagctgggcttctttcagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaaacccactcctaagaatctaccctaaagatacacctccaagaatatgaaactacgtagacacacaaggtaatccattacaacattgtaattgcaaaatattggaggcaacctaaatgcccatatgtgggagagtggatgagtaagctatagtgtagccacaccatggattagtatatagccatcaaaaagagtgggaagatctctgtgaactcatttagaggagttttcaggatatactgttaaatgaaaaaagctaaatacaaatgagtatctgtagtatactgtcactgatgtaaaaaggaaggagatataagaaaatacacatatatccacttacttgtgcagaagatacttggaaggataaaacaggaccaaagaagacagattacctagagagggtatgtggcaagggagggaaggagggagtaggggtggggaacaagggtgaggaggaagtgacagttgtctatacaagtctacc

SEQ ID NO: 1339 - DNA, 627 bp, synthetic construct
  misc_feature 1..627: note = Synthetic polypeptide
  source 1..627: mol_type = other DNA
gcacagcccggcggcagcagctggaggaggatcgcactgctcatcttggccatcactatacacaacgttccagagggtctcgctgttggagttggatttggggctatagaaaagacggcatctgctacctttgagagtgccaggaaacccactcctaagaatctaccctaaagatacacctccaagaatatgaaactacgtagacacacaaggtaatccattacaacattgtaattgcaaaatattggaggcaacctaaatgcccatatgtgggagagtggatgagtaagctatagtgtagccacaccatggattagtatatagccatcaaaaagagtgggaagatctctgtgaactcatttagaggagttttcaggatatactgttaaatgaaaaaagctaaatacaaatgagtatctgtagtatactgtcactgatgtaaaaaggaaggagatataagaaaatacacatatatccacttacttgtgcagaagatacttggaaggataaaacaggaccaaagaagacagattacctagagagggtatgtggcaagggagggaaggagggagtaggggtggggaacaagggtgaggaggaagtgacagttgtctatacaagtctacc

SEQ ID NO: 1340 - DNA, 1180 bp, synthetic construct
  misc_feature 1..1180: note = Synthetic polypeptide
  source 1..1180: mol_type = other DNA
atggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggcacctttcagcagcggccttgcttcctgcctccctccgccacctcctgcagatttctcctgggatcgccttccaaataaaccacctgcatttggggtctgtgtctggtggaaccc

SEQ ID NO: 1341 - DNA, 128 bp, synthetic construct; identical to SEQ ID NO: 144
  misc_feature 1..128: note = Synthetic polypeptide
  source 1..128: mol_type = other DNA

SEQ ID NO: 1342 - DNA, 588 bp, synthetic construct
  misc_feature 1..588: note = Synthetic polypeptide
  source 1..588: mol_type = other DNA
atgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcagaccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggctcatagttggaagaaacgtgccttgagtctcagattttggaattttgagttgatgctgaaatgagttgagacttttggggaactattgggaagggatgcttgtattctgcagtgcaaaaaggatgtgagatttgttggggggtcatgggcagaa

SEQ ID NO: 1343 - DNA, 402 bp, synthetic construct
  misc_feature 1..402: note = Synthetic polypeptide
  source 1..402: mol_type = other DNA
atgactcctgctcagattcagaccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggctcatagttggaagaaacgtgccttgagtctcagattttggaattttgagttgatgctgaaatgagttgagacttttggggaactattgggaagggatgcttgtattctgcagtgcaaaaaggatgtgagatttgttggggggtcatgggcagaa

SEQ ID NO: 1344 - DNA, 500 bp, synthetic construct
  misc_feature 1..500: note = Synthetic polypeptide
  source 1..500: mol_type = other DNA
atgttcccagcctccccctgggcacagccagcccaggccaagtggtctaggacactttgccagcaaggacaagatgatttgcttaataaaaaaaaaaaaaaaaaaaaaagactgcatccagccagataaggacataaacaagcacgctcctccactgtcagtcctcaccagaggactctatggtcataaacagctcaaaactgcggtcttaacagactcagtcttgctgtcactcatgatgagaacccagcattggctaccaaaggctctgccacatcaaagactcttccttgcaggaccaaaggactgcctggcccagaccaggagattctttttggcttcgttgctctccctggactggtttgttaaacctttctcctatctctattctcttgatgttgaatgttactttttgtctgtttgtggaatgtttaatctataacatttatgtattaagtatactattatctatggtttgcaatattgactgactttgtgga

SEQ ID NO: 1345 - DNA, 1018 bp, synthetic construct
  misc_feature 1..1018: note = Synthetic polypeptide
  source 1..1018: mol_type = other DNA
atggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgcttcaaagagaataaaatacctaagaatccaacttacaaaggatgtgaaggacgtcttcaaggagaactacaaaccactgctcaatgaagtaaaagaggacacaaacaaatggaagaacattccatgctcatggataggaagaatcaatatcatgataatggccatactgcgcgagaaaatct

SEQ ID NO: 1346 - DNA, 925 bp, synthetic construct
  misc_feature 1..925: note = Synthetic polypeptide
  source 1..925: mol_type = other DNA
atgggtgttgggacgaaggcgagggcctcccactggcggcgccttttgagccttggggccactccggaggagcctctgttggacttcaagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgcttcaaagagaataaaatacctaagaatccaacttacaaaggatgtgaaggacgtcttcaaggagaactacaaaccactgctcaatgaagtaaaagaggacacaaacaaatggaagaacattccatgctcatggataggaagaatcaatatcatgataatggccatactgcgcgagaaaatct

SEQ ID NO: 1347 - DNA, 736 bp, synthetic construct
  misc_feature 1..736: note = Synthetic polypeptide
  source 1..736: mol_type = other DNA
atgactatgaatatgaagagataccagatgacaattttagcatcccagaaggtgaagaagatctggcaaaagcaattcagatggcccaagaacaggctacagatactgaaattttggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgcttcaaagagaataaaatacctaagaatccaacttacaaaggatgtgaaggacgtcttcaaggagaactacaaaccactgctcaatgaagtaaaagaggacacaaacaaatggaagaacattccatgctcatggataggaagaatcaatatcatgataatggccatactgcgcgagaaaatct

SEQ ID NO: 1348 - DNA, 500 bp, synthetic construct; identical to SEQ ID NO: 204
  misc_feature 1..500: note = Synthetic polypeptide
  source 1..500: mol_type = other DNA

SEQ ID NO: 1349 - DNA, 656 bp, synthetic construct; identical to SEQ ID NO: 205
  misc_feature 1..656: note = Synthetic polypeptide
  source 1..656: mol_type = other DNA

SEQ ID NO: 1350 - DNA, 524 bp, synthetic construct; identical to SEQ ID NO: 207
  misc_feature 1..524: note = Synthetic polypeptide
  source 1..524: mol_type = other DNA

SEQ ID NO: 1351 - DNA, 588 bp, synthetic construct
  misc_feature 1..588: note = Synthetic polypeptide
  source 1..588: mol_type = other DNA
atgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggctcatagttggaagaaacgtgccttgagtctcagattttggaattttgagttgatgctgaaatgagttgagacttttggggaactattgggaagggatgcttgtattctgcagtgcaaaaaggatgtgagatttgttggggggtcatgggcagaa

SEQ ID NO: 1352 - DNA, 267 bp, synthetic construct
  misc_feature 1..267: note = Synthetic polypeptide
  source 1..267: mol_type = other DNA
atgacactggcaactgacggcactgcggatatgtttggaataaggttcaaaagaagaggctgttctaagaaagactaccgagtaatcaatcacctcctcagagaaagtctgctcaggaaactctcctcccaccagcccctgcacttggttccttgcgttgcctctggctggaagctgttgtccccaacttcagaaagtgtctgcagatttcacaggctctctcttgggtcaagattgcacattccccaggggaagtacctggtgcct

SEQ ID NO: 1353 - DNA, 2187 bp, synthetic construct
  misc_feature 1..2187: note = Synthetic polypeptide
  source 1..2187: mol_type = other DNA
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcaggactgcaaggggcctactctgtcacctgtggctcttcctctcctctcaggaacaaacaacaaaaatcaaatgactctgcttttggggatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgttacctgggtcaaccatggtccaagaatatcaaatggaaaattccagaaataaacaatttgtaagttttaaattgcccactcttcagagtggtgtgatgaaatctcgtgttgtcctgctccatcctgcctgggatatgaatcctccctttatgctgcgtacccacggtgtataccctccccatcc

SEQ ID NO: 1354 - DNA, 2100 bp, synthetic construct
  misc_feature 1..2100: note = Synthetic polypeptide
  source 1..2100: mol_type = other DNA
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcagatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgttacctgggtcaaccatggtccaagaatatcaaatggaaaattccagaaataaacaatttgtaagttttaaattgcccactcttcagagtggtgtgatgaaatctcgtgttgtcctgctccatcctgcctgggatatgaatcctccctttatgctgcgtacccacggtgtataccctccccatcc

SEQ ID NO: 1355 - DNA, 1722 bp, synthetic construct
  misc_feature 1..1722: note = Synthetic polypeptide
  source 1..1722: mol_type = other DNA
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgttacctgggtcaaccatggtccaagaatatcaaatggaaaattccagaaataaacaatttgtaagttttaaattgcccactcttcagagtggtgtgatgaaatctcgtgttgtcctgctccatcctgcctgggatatgaatcctccctttatgctgcgtacccacggtgtataccctccccatcc

SEQ ID NO: 1356 - DNA, 4120 bp, synthetic construct
  misc_feature 1..4120: note = Synthetic polypeptide
  source 1..4120: mol_type = other DNA
atgtctcagcaccagctccgcgtgccgcagcccgagggcctgggccgaaagagaaccagctcggaggacaacctgtacctggctgtgctcagggcctctgagggcaagaaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1357 - DNA, 4132 bp, synthetic construct
  misc_feature 1..4132: note = Synthetic polypeptide
  source 1..4132: mol_type = other DNA
atgtcgggggcggggggcgcctttgcctcgccgagggaggtcttgctggagcggccgtgctggctggacgggggctgcgagccggcccgcaggggctacctctaccagcagctgtgctgcgtagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1358 - DNA, 4120 bp, synthetic construct
  misc_feature 1..4120: note = Synthetic polypeptide
  source 1..4120: mol_type = other DNA
atggagccctcgggcagcctgtttccctccctggtggttgtgggtcacgttgtcaccctggccgctgtgtggcactggcgcaggggacgtcggtgggcgcaggacgagcaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1359 - DNA, 4024 bp, synthetic construct
  misc_feature 1..4024: note = Synthetic polypeptide
  source 1..4024: mol_type = other DNA
atgaagatcgtgcccgatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1360 - DNA, 4531 bp, synthetic construct
  misc_feature 1..4531: note = Synthetic polypeptide
  source 1..4531: mol_type = other DNA
atggtggccggcatgctcatgccacgggaccagctgcgggccatctatgaggtgctcttccgcgagggcgtgatggtggccaagaaggaccggcggccccgcagcttgcacccccatgtgcccggcgtcaccaacctgcaggtcatgcgtgccatggcgtccctgcgggcacggggcctggtccgcgagacctttgcctggtgccacttttactggtacctcaccaatgaaggcatcgcccacctccgccagtacctgcacctgccgccagagatcgtgcccgcctctctgcagcgcgtgcgccgccccgtcgccatggtgatgcccgcacgccgcaccccccacgtgcaggctgtgcagggtcccctgggctccccacccaagcgggggccgctgccgacggaggagcagcgggtctaccgtcggaaggagcttgaggaggtgtcacctgagacccctgtggtgcctgctaccacccagcggaccctggccaggccaggcccggagcctgccccagccacagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1361 - DNA, 4054 bp, synthetic construct
  misc_feature 1..4054: note = Synthetic polypeptide
  source 1..4054: mol_type = other DNA
atggacccctcgcgagccatccagaacgagatcagctccctcaaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1362 - DNA, 4078 bp, synthetic construct
  misc_feature 1..4078: note = Synthetic polypeptide
  source 1..4078: mol_type = other DNA
atggccggcccgctgcccgacgagcaggacttcatccaggcctacgaggaggtgcgcgagaagtacaaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1363 - DNA, 4201 bp, synthetic construct
  misc_feature 1..4201: note = Synthetic polypeptide
  source 1..4201: mol_type = other DNA
atgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1364 - DNA, 4189 bp, synthetic construct
  misc_feature 1..4189: note = Synthetic polypeptide
  source 1..4189: mol_type = other DNA
atgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1365 - DNA, 210 bp, synthetic construct
  misc_feature 1..210: note = Synthetic polypeptide
  source 1..210: mol_type = other DNA
aggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1366 - DNA, 718 bp, synthetic construct
  misc_feature 1..718: note = Synthetic polypeptide
  source 1..718: mol_type = other DNA
atgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaagaggagaaggagcagtccgtgctcaaaaaactgcatcagcagtttgaaatgtataaagagcaggtaaagaagatgggagaagaatcacagcaacagcaagaacagaagggtgatgcgccaacctgtggtatctgccacaaaacaaagtttgctgatggatgtggccataactgttcatattgccaaacaaagttctgtgctcgttgtggaggtcgagtgtcattacgctcaaacaaggttatgtgggtatgtaatttgtgccgaaaacaacaagaaatcctcactaaatcaggagcatggttttataatagtggatctaatacaccacagcaacctgatcaaaaggttcttcgagggctaagaaatgaggaggcacctcaggagaagaaaccaaaactacatgagcagacccagttccaaggaccctcaggtgacttatctgtacctgcagtggagaaaagtcgatctcatgggctcacaagacagcattctattaaaaatgggtcaggcgtgaagcatcacattgccagtgacatagcttcagacaggaaaacttcctctgaacttc

SEQ ID NO: 1367 - DNA, 720 bp, synthetic construct
  misc_feature 1..720: note = Synthetic polypeptide
  source 1..720: mol_type = other DNA
aggcacctctggggtggcacctggcacaacagttgcccctggaagtttcagcacagcagctacaacttctcctggagcaagtggagtgactggcactggacccactgcagagaccacaactttcctaggaggaagtagcaccactggagcagaaataaaatcaggagccaccactggagcaccaggaagtaagacaggcacagctaaagtgctctctggtacgacagttgcctctgggagctccaactcagaggctacaactttctctggaatcactgaagcagtaacagtcccaagtaaaaatggatctatgaccactgcactggggagccaactctccagcagtcaaacagtgattccaggttccagtggcaccatctctcacacaactgttgcacctggaagttctgttacaggaaccaccactggtgcatcagatgatcaagtcactggaagtaaaacaggcactactggtgtggccttgagcacaactgttgcacctggaagttccagtacagaagccacaacttccacaggagtccatagaaccactgtagtgggacagaagacaggagctaccactagagggtcagcaaagcaaggaactagaagcacaatagctattcaggaggctgaggcaggaggatcacttgaacctggatggaggttgcagtgagagatagcaccattgcactccagcctgggtgacagagagagact

SEQ ID NO: 1368 - DNA, 281 bp, synthetic construct
  misc_feature 1..281: note = Synthetic polypeptide
  source 1..281: mol_type = other DNA
atgcggctgctgcccctgctgcggactgtcctctgggccgcgttcctcggctcccctctgcgcgggggctccagcctccgccacgtagtctactggaactccagtaaccccagtgtcagccctgcccttctagccgaatcacctctgggcaagtctcgtgaccttcctaacctcatttatctcacctgtataatgggctaataatacctagtaccctgggaagtctggcagggtaagtgaggtcatgtatgtgaaagaggctcaggctgtacagatataaa

SEQ ID NO: 1369 - DNA, 573 bp, synthetic construct
  misc_feature 1..573: note = Synthetic polypeptide
  source 1..573: mol_type = other DNA
atggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactggtgaaaccccatctctactaaaaagcaaaaattagctgggtgtggtggcatgtgcctgtaatcccacctactcaggaggctgaggcaggagaatcccttgaacctgggtggcagaggttgcagtgagctgagattacgccactacactccagcctgggcgacagagcaagacttcgtgtcaaaaaaaaaaaaaaagaaaaaaaaaaaaa

SEQ ID NO: 1370 - DNA, 416 bp, synthetic construct
  misc_feature 1..416: note = Synthetic polypeptide
  source 1..416: mol_type = other DNA
ggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactggtgaaaccccatctctactaaaaagcaaaaattagctgggtgtggtggcatgtgcctgtaatcccacctactcaggaggctgaggcaggagaatcccttgaacctgggtggcagaggttgcagtgagctgagattacgccactacactccagcctgggcgacagagcaagacttcgtgtcaaaaaaaaaaaaaaagaaaaaaaaaaaaa

SEQ ID NO: 1371 - DNA, 6019 bp, synthetic construct
  misc_feature 1..6019: note = Synthetic polypeptide
  source 1..6019: mol_type = other DNA
atgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagaccacagtgcaataaaactagaactcaggattaagaacctcactcaaaaccacttaactacatggaaactgaacaacctcctccagaatgactactgggtacataacgaaatcaaggcagaaataaatatgttctttgaaaccgatgagaacaaaggcaccacataccagaatctgtgggacacatttaaagcagtgtgtagagggaaatttatagcactaaatgcccacaagagaaagcaggaaagatctaaaattgatacactaacatcacaattaaaagaactagagaagcaagagcaaacacattcaaaagctagcagaaggcaagaaataactaaaatcagagcagaattgaaggagatagagacacaaaaaatccttcaaaaaatcaatgaatccaggagctggttttttgaaaagattaacaaatatgatagactgctagcaagactaataaagaagaaaagtgagaagaatcaaatagacacaataaaaaatgataaaggggatatcaccaccgatcccacagaaatacaaactaccatcagagaatactataaacacctctatgcaaataaactggagaatctagaaaaaatggataaattcctggacagctacaccctcccaagactaaaccaggaaggagaatccccgaatagaccaataacaggctctgtaattgaggcaataattaatagcctaccaaccaagaaaagtccaggactggacagattcccagccaaattctaccagaggtacaaggaggagctgataccattccttctgaaatgattccaatcaatagaaaaagagggaatcctccctaactcattttatgaggccagcatcatcctgataccaaagcctggcagagacacaacaaaaaaacagaattttagaccagtatccctgatgaacatcaatgcaaaaatcctcaataaaatactggcaaaccgaatccagcagcacatcagaaagcttatccaccatgatcaagttggcttcatccctgggatgcaaggctggttcaagatatgcaaatcaataaatataattcatcatataaacagaaccaaaaacaaaaaccacatgattatctcaatagatgcagaaaaggcctttgacaaaattcaacagcacttcatgctaaaaactctcaataaactaggtattgatgggatgtatctcaaaataataagatctatttatgacaaacccacagccagtatcataccgaatgggcaaaaactggaagcattccctttgaaaactggcacaagacagggatgccctctctcaccactgctattcaacatagtgttggaagttctggccagggcaatcacacaggagaaagaaatgaatggtattcaataaggaatagaggaagtcaaattttccctgtttgcagatgacatgattgtatatttagaaaaccccattgtctcagcccgaaatcttcttaagctgatataagcagcatcagcaaagtctcaggatacataataaatgtgcaaaaatcacaagcactcttatacaccaataacagacaaacagagaaccaaatcatgagtgaactcccattcacaattgcttcaaagagaataaaatatctaggaatccaacttacaagggatgtgaaggacctcttcaaggagaactatacaccactgcttaacgaaataaaagaggacacaaacaaatggaagagcattccatgcttatggataggaagaatcaatatcgtgaaaatggccatactgcccaaggtaatttatggattcaatgccatccccattaagctaccaatgactttcttcacagaattggaaaaactactttaaagttcatatggaaccaaaaaagagcctgcagtgccaagacgatcctaagccaaaataacaaagctggaggcatcacactacctgacttcaaactatactacaaggctacagtaaccaaaacagcatggtattagtaccaaaacagagatatagatgaatggaacagaaccacacatctacaaccatctgatctttgatgaaccagacaaaaacaagaaatggggaaaggattccctatttaataaatggtgctgggaaaactggctagccatatgtagaaagctgaaactggatcccttccttacaacttatacaaaaattaattcaagatggattaaagacttaaatgttagacctaaaaccataaaaaccctagaagaaaacctaggcaataccattcaggacaaaggcatgggcaaagtcttcatgactaaaacaccaaaagcaatggcaacaaaagccaaaattgacaaatgggatctaattaaactaaagagcttcttctgcacagcaaaagaaactaccatgagaatgaacaggcaacctttttgcaatctacccatctgacaaagggctaatatccagaatctacaaaaacttaagtttacaagaaaaaatcaaacaccccatgaaaaagtgggcaaaggatatgaacagacacttctcaaaagaagatatttatgcagacaacagacacatgaaaaaatcctcatcatcacctgtcatcagagaaatgcaaatcaaaaccatgatgagatatcatctcacaccagttagaatggcgatcattaaaaagtcaggaaacaacaggtgctggagaggatgtggagaaataggaacgcttttacactgttggtgggagtgtaaactagttcaaccattgtggaagacagtgtggtgattcctgaaggatctagaactagaaataccatttgacccagggatcccattactggttatatacccaaaggattataaatcgtgctactgtaaagacacatgcacacatatgtttattgcagcactcttcacaatagcaaagacttggaactaacccaaatatacatcaatgatagactggattaagaaaatgtggcacatatacaccatggaattctctgcagccataaaaaaggatgtgttcatatcctttgtagggacatggatgaagctggaaaccatcattctgagcaaactatcgcaaggacagaaaaccaaacatcacatgttctcacccataggtgggaattgaacaatgagaacacttggacacaggaagtgcaacatcacacacgggggcctgtcatggggtggggggaggtgggagggatagcattaagagaaatacctaatgtaaatgacgagttaatgggtgcagtgcaccaatatggcacatgtatacatatgtaaaaaacctgcacgttgtgcagatgtactctagaacttaatgtataataacaacaaaaaaa

SEQ ID NO: 1372 - DNA, 6376 bp, synthetic construct
  misc_feature 1..6376: note = Synthetic polypeptide
  source 1..6376: mol_type = other DNA
atgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagaccacagtgcaataaaactagaactcaggattaagaacctcactcaaaaccacttaactacatggaaactgaacaacctcctccagaatgactactgggtacataacgaaatcaaggcagaaataaatatgttctttgaaaccgatgagaacaaaggcaccacataccagaatctgtgggacacatttaaagcagtgtgtagagggaaatttatagcactaaatgcccacaagagaaagcaggaaagatctaaaattgatacactaacatcacaattaaaagaactagagaagcaagagcaaacacattcaaaagctagcagaaggcaagaaataactaaaatcagagcagaattgaaggagatagagacacaaaaaatccttcaaaaaatcaatgaatccaggagctggttttttgaaaagattaacaaatatgatagactgctagcaagactaataaagaagaaaagtgagaagaatcaaatagacacaataaaaaatgataaaggggatatcaccaccgatcccacagaaatacaaactaccatcagagaatactataaacacctctatgcaaataaactggagaatctagaaaaaatggataaattcctggacagctacaccctcccaagactaaaccaggaaggagaatccccgaatagaccaataacaggctctgtaattgaggcaataattaatagcctaccaaccaagaaaagtccaggactggacagattcccagccaaattctaccagaggtacaaggaggagctgataccattccttctgaaatgattccaatcaatagaaaaagagggaatcctccctaactcattttatgaggccagcatcatcctgataccaaagcctggcagagacacaacaaaaaaacagaattttagaccagtatccctgatgaacatcaatgcaaaaatcctcaataaaatactggcaaaccgaatccagcagcacatcagaaagcttatccaccatgatcaagttggcttcatccctgggatgcaaggctggttcaagatatgcaaatcaataaatataattcatcatataaacagaaccaaaaacaaaaaccacatgattatctcaatagatgcagaaaaggcctttgacaaaattcaacagcacttcatgctaaaaactctcaataaactaggtattgatgggatgtatctcaaaataataagatctatttatgacaaacccacagccagtatcataccgaatgggcaaaaactggaagcattccctttgaaaactggcacaagacagggatgccctctctcaccactgctattcaacatagtgttggaagttctggccagggcaatcacacaggagaaagaaatgaatggtattcaataaggaatagaggaagtcaaattttccctgtttgcagatgacatgattgtatatttagaaaaccccattgtctcagcccgaaatcttcttaagctgatataagcagcatcagcaaagtctcaggatacataataaatgtgcaaaaatcacaagcactcttatacaccaataacagacaaacagagaaccaaatcatgagtgaactcccattcacaattgcttcaaagagaataaaatatctaggaatccaacttacaagggatgtgaaggacctcttcaaggagaactatacaccactgcttaacgaaataaaagaggacacaaacaaatggaagagcattccatgcttatggataggaagaatcaatatcgtgaaaatggccatactgcccaaggtaatttatggattcaatgccatccccattaagctaccaatgactttcttcacagaattggaaaaactactttaaagttcatatggaaccaaaaaagagcctgcagtgccaagacgatcctaagccaaaataacaaagctggaggcatcacactacctgacttcaaactatactacaaggctacagtaaccaaaacagcatggtattagtaccaaaacagagatatagatgaatggaacagaaccacacatctacaaccatctgatctttgatgaaccagacaaaaacaagaaatggggaaaggattccctatttaataaatggtgctgggaaaactggctagccatatgtagaaagctgaaactggatcccttccttacaacttatacaaaaattaattcaagatggattaaagacttaaatgttagacctaaaaccataaaaaccctagaagaaaacctaggcaataccattcaggacaaaggcatgggcaaagtcttcatgactaaaacaccaaaagcaatggcaacaaaagccaaaattgacaaatgggatctaattaaactaaagagcttcttctgcacagcaaaagaaactaccatgagaatgaacaggcaacctttttgcaatctacccatctgacaaagggctaatatccagaatctacaaaaacttaagtttacaagaaaaaatcaaacaccccatgaaaaagtgggcaaaggatatgaacagacacttctcaaaagaagatatttatgcagacaacagacacatgaaaaaatcctcatcatcacctgtcatcagagaaatgcaaatcaaaaccatgatgagatatcatctcacaccagttagaatggcgatcattaaaaagtcaggaaacaacaggtgctggagaggatgtggagaaataggaacgcttttacactgttggtgggagtgtaaactagttcaaccattgtggaagacagtgtggtgattcctgaaggatctagaactagaaataccatttgacccagggatcccattactggttatatacccaaaggattataaatcgtgctactgtaaagacacatgcacacatatgtttattgcagcactcttcacaatagcaaagacttggaactaacccaaatatacatcaatgatagactggattaagaaaatgtggcacatatacaccatggaattctctgcagccataaaaaaggatgtgttcatatcctttgtagggacatggatgaagctggaaaccatcattctgagcaaactatcgcaaggacagaaaaccaaacatcacatgttctcacccataggtgggaattgaacaatgagaacacttggacacaggaagtgcaacatcacacacgggggcctgtcatggggtggggggaggtgggagggatagcattaagagaaatacctaatgtaaatgacgagttaatgggtgcagtgcaccaatatggcacatgtatacatatgtaaaaaacctgcacgttgtgcagatgtactctagaacttaatgtataataacaacaaaaaaa

SEQ ID NO: 1373 - DNA, 1348 bp, synthetic construct
  misc_feature 1..1348: note = Synthetic polypeptide
  source 1..1348: mol_type = other DNA
atgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaaaagtaaattttcgcagaaggacttagaaatgctattccatggaatgagtgctgattttacaagtgagaatttctcagcagcctggtatcttatagagaatcactcaaacaccagttttgagcagctcaaaatggcagtcaccaacctaaagagacaggctaacaagaagagtgagggcagcctggcctatgtgaaaggcggtctcagtacattcttcgaagcacaggatgccctctcagccatccatcaaaaactagaagcagatggaacggaaaaagtagaaggatccatgacgcagaaactggagaatgttctgaacagtgctctggatgatcagccacactgcctccttcaaggccaccagcgatagtcactgtacgtctgttaccagttctcagcagacagcaaagtgtgcagttgtgctacctccttatctcccagtgacaaaccctcctgacattttacaaaaatggatgatcgggaagggattggtcgataaagatgaaagtgcatcaaaaaccaggaagctctaacactggaagtgaaacgcaaatccaccaaatggagagtgacggaaggaatagctggctgtggggatgtaggtcctcctgtctttgagactcaagagtaactcagtggaggggaacttcccaacaaaggtgagcaaatgtgaagaaaagcatgagatgtcccaaaggaagcaatgctcagagaacctcagagatgtttcatgatgtggacggtgcaaaggaaaaaatatcagaagttgattcacgcttagaaaggagcaggataatctgtcagagcacagaaaagaggcttgattcatattgtaaatattacaacaaaaaagaaggcaaacactcttgataagtttttctacaaagaaatatgacgctttaattttaaatgtttctgatgtttta

SEQ ID NO: 1374 - DNA, 857 bp, synthetic construct
  misc_feature 1..857: note = Synthetic polypeptide
  source 1..857: mol_type = other DNA
atgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagatcgaagagctggagctccagtgggcatcttgggccctgagatgacattggggaaagaaagttttctggaacaaggtgacactgtgggcacaaaaactatcccaactctagacttcttgagtgtaaaagacatatcgacttctatcttgtttaagccactattactacgagattttttcttttacaatcaaatctaa

SEQ ID NO: 1375 - DNA, 559 bp, synthetic construct
  misc_feature 1..559: note = Synthetic polypeptide
  source 1..559: mol_type = other DNA
atgcgcttgctccagctcctgttcagggccagccctgccaccctgctcctggttctctgcctgcagttgggggccaacaaagctcaggacaacactcggaagatcataataaagaattttgacattcccaagtcagtacgtccaaatgacgaagtcactgcagtgcttgcagttcaaacagaattgaaagaatgcatggtggttggatgaagcaaactaccattctggaaagacccagatggcaagaaattgaaggtggcctctaaccaacagctagcaaggaactgaggccctcagtccaaaacccacagggaactgaatgctgccaacaaccatgtgggcttggaaacatgcccttccatcattaagccttcagaaagaacgtatccctggcaaacacctggattgtagcctgtgaaaaatgctgaagcagaggacccagttaatctgtgcccaaaattcttgaccccagaaactgaaagataataaatgtgtgtgcatgttttttaaggcactgcatttgtggtaattcattatgcaccaatagataactaataca

SEQ ID NO: 1376 - DNA, 610 bp, synthetic construct; identical to SEQ ID NO: 163
  misc_feature 1..610: note = Synthetic polypeptide
  source 1..610: mol_type = other DNA

SEQ ID NO: 1377 - DNA, 1052 bp, synthetic construct; identical to SEQ ID NO: 247
  misc_feature 1..1052: note = Synthetic polypeptide
  source 1..1052: mol_type = other DNA

SEQ ID NO: 1378 - DNA, 327 bp, synthetic construct; identical to SEQ ID NO: 246
  misc_feature 1..327: note = Synthetic polypeptide
  source 1..327: mol_type = other DNA

SEQ ID NO: 1379 - DNA, 506 bp, synthetic construct; identical to SEQ ID NO: 1096
  misc_feature 1..506: note = Synthetic polypeptide
  source 1..506: mol_type = other DNA

SEQ ID NO: 1380 - DNA, 1216 bp, synthetic construct
  misc_feature 1..1216: note = Synthetic polypeptide
  source 1..1216: mol_type = other DNA
atggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtctttgttcatgctgttttccctgccgtggacaccctttcccgctctctgattctctaaatcctgccccatctcccagatcttgttcatgtccaagcttttccaggaagtctt

SEQ ID NO: 1381 - DNA, 1363 bp, synthetic construct; identical to SEQ ID NO: 209
  misc_feature 1..1363: note = Synthetic polypeptide
  source 1..1363: mol_type = other DNA

SEQ ID NO: 1382 - DNA, 2101 bp, synthetic construct
  misc_feature 1..2101: note = Synthetic polypeptide
  source 1..2101: mol_type = other DNA
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcaggactgcaaggggcctactctgtcacctgtggctcttcctctcctctcaggaacaaacaacaaaaatcaaatgactctgcttttggggatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtggcccagagctccccggagtgagactgacctcattcatctccctgtcctcagcacctggcatagtatctggcttgtggtgggcactaaaatgttggttga

SEQ ID NO: 1383 - DNA, 2014 bp, synthetic construct
  misc_feature 1..2014: note = Synthetic polypeptide
  source 1..2014: mol_type = other DNA
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcagatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtggcccagagctccccggagtgagactgacctcattcatctccctgtcctcagcacctggcatagtatctggcttgtggtgggcactaaaatgttggttga

SEQ ID NO: 1384 - DNA, 1636 bp, synthetic construct
  misc_feature 1..1636: note = Synthetic polypeptide
  source 1..1636: mol_type = other DNA
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtggcccagagctccccggagtgagactgacctcattcatctccctgtcctcagcacctggcatagtatctggcttgtggtgggcactaaaatgttggttga

SEQ ID NO: 1385 - DNA, 1654 bp, synthetic construct
  misc_feature 1..1654: note = Synthetic polypeptide
  source 1..1654: mol_type = other DNA
atgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgagggaattaaatttcctagactcgtttgctttctggagttggctaataggaggcactaacagaagattggagggtgagaggagggaagaagccagggtctttccccagtccctttttgagccaactccagcagcagctcccttgtgtcctattaacacagccccttcctcatggtcccagttactactgagcagatcctgctatggttctagcaccatcctgagcttctgggatatggtgagactacatcatcttattgtcctttcagtgctagaagtcatagaagctccctgctattactagtctctgggtttcctcactttcctctgttttgtataaccggttctctatagtgaatttcttctgtgtgaaa

SEQ ID NO: 1386 - DNA, 632 bp, synthetic construct
  misc_feature 1..632: note = Synthetic polypeptide
  source 1..632: mol_type = other DNA
tgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgagggaattaaatttcctagactcgtttgctttctggagttggctaataggaggcactaacagaagattggagggtgagaggagggaagaagccagggtctttccccagtccctttttgagccaactccagcagcagctcccttgtgtcctattaacacagccccttcctcatggtcccagttactactgagcagatcctgctatggttctagcaccatcctgagcttctgggatatggtgagactacatcatcttattgtcctttcagtgctagaagtcatagaagctccctgctattactagtctctgggtttcctcactttcctctgttttgtataaccggttctctatagtgaatttcttctgtgtgaaa

SEQ ID NO: 1387 - DNA, 756 bp, synthetic construct
  misc_feature 1..756: note = Synthetic polypeptide
  source 1..756: mol_type = other DNA
atgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggcagtatgatcttgtatgtagaagacctggaagaatctacaaagaagctaccagaataagtgagtttatcaaggtctcaagatcaatgtataaaaacggttatctttcgttatactgcaaatacacaattggaaaatgaaattttaaaacttctgtttatagtagcacccaaaacttgaattactcagg

SEQ ID NO: 1388 - DNA, 1389 bp, synthetic construct
  misc_feature 1..1389: note = Synthetic polypeptide
  source 1..1389: mol_type = other DNA
atgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacaagacttcccacaggtgaagagaccactaaaagcatccaggaccagacagccatccaggaccaaccttccagttctgtctgtgaacgaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggcagtatgatcttgtatgtagaagacctggaagaatctacaaagaagctaccagaataagtgagtttatcaaggtctcaagatcaatgtataaaaacggttatctttcgttatactgcaaatacacaattggaaaatgaaattttaaaacttctgtttatagtagcacccaaaacttgaattactcagg

SEQ ID NO: 1389 - DNA, 1370 bp, synthetic construct
  misc_feature 1..1370: note = Synthetic polypeptide
  source 1..1370: mol_type = other DNA
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagccactccaacattcagcaaccagcacgctgatcagtcagcagccatcaacatcgagacaagaccctccaccaacaaaaagattacaacttgctgaaggctcagatgatccttagcatttttcagcaacaaagtatttttcagtaagtaatgttcatgtattttagacataattctgttgaacacttaatagactatagtgtacacataacttttata

SEQ ID NO: 1390 - DNA, 3174 bp, synthetic construct
  misc_feature 1..3174: note = Synthetic polypeptide
  source 1..3174: mol_type = other DNA
atgataaccaccctcccatctctcctacccgccagcctcgccagtatctcccaccgagtcacgaatctcccatctaactccctctcacacaacccaggcctctccaagcctgactttcccggaaactccagtccaggtcttccttcctcctccagcccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1391 - DNA, 3024 bp, synthetic construct
  misc_feature 1..3024: note = Synthetic polypeptide
  source 1..3024: mol_type = other DNA
atgctatcgggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1392 - DNA, 3081 bp, synthetic construct
  misc_feature 1..3081: note = Synthetic polypeptide
  source 1..3081: mol_type = other DNA
atggctgatggaggcgctgattcggcagcgcaaagacttccagaaggcccgggcagagtagccccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1393 - DNA, 2985 bp, synthetic construct
  misc_feature 1..2985: note = Synthetic polypeptide
  source 1..2985: mol_type = other DNA
atgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1394 - DNA, 2775 bp, synthetic construct
  misc_feature 1..2775: note = Synthetic polypeptide
  source 1..2775: mol_type = other DNA
atgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1395 - DNA, 2949 bp, synthetic construct
  misc_feature 1..2949: note = Synthetic polypeptide
  source 1..2949: mol_type = other DNA
atgcctgcttcaatctcctccatcttcccaggtccaactctgcttttgtcttgtggctcagaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1396 - DNA, 1590 bp, synthetic construct
  misc_feature 1..1590: note = Synthetic polypeptide
  source 1..1590: mol_type = other DNA
atgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1397 - DNA, 849 bp, synthetic construct
  misc_feature 1..849: note = Synthetic polypeptide
  source 1..849: mol_type = other DNA
atggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1398 - DNA, 2911 bp, synthetic construct
  misc_feature 1..2911: note = Synthetic polypeptide
  source 1..2911: mol_type = other DNA
atgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagaattggaaaaactactttaaagttcatatggaaccaaaaaagagcccgcattgtcaagtcaatcctaagccaaaagaacaaagctgcaggcatcacgctacctgacttcaaactataccacaaggctacagtaaccaaaacagcatggtactggtaccaaaacagagatatagaccaatggaatagaacagagtcctcagaaataacgtc

SEQ ID NO: 1399 - DNA, 3268 bp, synthetic construct
  misc_feature 1..3268: note = Synthetic polypeptide
  source 1..3268: mol_type = other DNA
atgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagaattggaaaaactactttaaagttcatatggaaccaaaaaagagcccgcattgtcaagtcaatcctaagccaaaagaacaaagctgcaggcatcacgctacctgacttcaaactataccacaaggctacagtaaccaaaacagcatggtactggtaccaaaacagagatatagaccaatggaatagaacagagtcctcagaaataacgtc

SEQ ID NO: 1400 - DNA, 393 bp, synthetic construct
  misc_feature 1..393: note = Synthetic polypeptide
  source 1..393: mol_type = other DNA
atgtcacactacttctacttgactccacaaattcttctgccctttagccctcttacttctcaagagtttgatctgatcagacgcaaggctggagcatcttggcaggatgaaacacgatggtcagattcttccgtgacaacatacacaggcagttaccggaaaaaacaactggacaagtccatgtgcagccaattttcttttagagcaggacagcatgagcctgagtgtaaacagatgtcattgacaaacagttctgcctgtcatcttctctgctgggctggtacccaagagactacagatatcaaagactcagcccacctgcacccaggtgattaaaagctttattgctcacacaaagcctgtttggtggtctcttcacacggatgcgcaaga

SEQ ID NO: 1401 - DNA, 272 bp, synthetic construct
  misc_feature 1..272: note = Synthetic polypeptide
  source 1..272: mol_type = other DNA
cagattcttccgtgacaacatacacaggcagttaccggaaaaaacaactggacaagtccatgtgcagccaattttcttttagagcaggacagcatgagcctgagtgtaaacagatgtcattgacaaacagttctgcctgtcatcttctctgctgggctggtacccaagagactacagatatcaaagactcagcccacctgcacccaggtgattaaaagctttattgctcacacaaagcctgtttggtggtctcttcacacggatgcgcaaga

SEQ ID NO: 1402 - DNA, 5853 bp, synthetic construct; identical to SEQ ID NO: 376
  misc_feature 1..5853: note = Synthetic polypeptide
  source 1..5853: mol_type = other DNA

SEQ ID NO: 1403 - DNA, 5829 bp, synthetic construct; identical to SEQ ID NO: 377
  misc_feature 1..5829: note = Synthetic polypeptide
  source 1..5829: mol_type = other DNA

SEQ ID NO: 1404 - DNA, 1950 bp, synthetic construct; identical to SEQ ID NO: 378
  misc_feature 1..1950: note = Synthetic polypeptide
  source 1..1950: mol_type = other DNA

SEQ ID NO: 1405 - DNA, 2072 bp, synthetic construct; identical to SEQ ID NO: 379
  misc_feature 1..2072: note = Synthetic polypeptide
  source 1..2072: mol_type = other DNA

SEQ ID NO: 1406 - DNA, 1120 bp, synthetic construct
  misc_feature 1..1120: note = Synthetic polypeptide
  source 1..1120: mol_type = other DNA
atgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggacatggatgaagccagaagccatcattctcagcaaactaacacaggaacagaaaaccaaacacctcatgttcgcactcataagtgggagttgaacaatgagaacacatggacacagggagtggagcatcacacaacggggcctgtcgggagttgggggactaggggagggagagcattaggacaaatacctaatgcatgtggggcttaaaacctagatgacgggttgataggtgtagcaaaccaccatggcacatgtatacctatgtaacaaacctgcacgttctgcacatatatcccagaactaaaagtaaaataaatgaaaaagaaataaaaaataataaaataaaataaaataaa

SEQ ID NO: 1407 - DNA, 601 bp, synthetic construct
  misc_feature 1..601: note = Synthetic polypeptide
  source 1..601: mol_type = other DNA
atggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggacatggatgaagccagaagccatcattctcagcaaactaacacaggaacagaaaaccaaacacctcatgttcgcactcataagtgggagttgaacaatgagaacacatggacacagggagtggagcatcacacaacggggcctgtcgggagttgggggactaggggagggagagcattaggacaaatacctaatgcatgtggggcttaaaacctagatgacgggttgataggtgtagcaaaccaccatggcacatgtatacctatgtaacaaacctgcacgttctgcacatatatcccagaactaaaagtaaaataaatgaaaaagaaataaaaaataataaaataaaataaaataaa

SEQ ID NO: 1408 - DNA, 475 bp, synthetic construct
  misc_feature 1..475: note = Synthetic polypeptide
  source 1..475: mol_type = other DNA
cataacgactatatgtgtccagccaccaaccagtgcaccattgataaaaacaggaggaagagctgccaggcctgccggctccgtaaatgctacgaagtgggaatgatgaaaggtgggacatggatgaagccagaagccatcattctcagcaaactaacacaggaacagaaaaccaaacacctcatgttcgcactcataagtgggagttgaacaatgagaacacatggacacagggagtggagcatcacacaacggggcctgtcgggagttgggggactaggggagggagagcattaggacaaatacctaatgcatgtggggcttaaaacctagatgacgggttgataggtgtagcaaaccaccatggcacatgtatacctatgtaacaaacctgcacgttctgcacatatatcccagaactaaaagtaaaataaatgaaaaagaaataaaaaataataaaataaaataaaataaa

SEQ ID NO: 1409 - DNA, 1883 bp, synthetic construct
  misc_feature 1..1883: note = Synthetic polypeptide
  source 1..1883: mol_type = other DNA
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgcactgttcacaatagcaaagacatggagtcaacccaaatggccatcaatgatagactggataaagaaaatgtggtatttgcagccataaaaaggaatgagatcatgtcctttgcaggaacatggatggagctggaagtcattatcctcagcagactaacacaggaacagacaaccaaacactgcacgttctcacttgtaagtgggagctgaacaatgagaacacatggacacagggaggggaacagcacaccctggggcctgttgggggagtgtggggagggagagcatcaggataaatagttaatgcatatggggcttaatacctaggtgatgggttgataggtccagcaaactaccatggcatgcatttacctatgtaacaaacctgcagttcctgctcatgtatctcagaactttaaattaaattagaaa

SEQ ID NO: 1410 - DNA, 667 bp, synthetic construct
  misc_feature 1..667: note = Synthetic polypeptide
  source 1..667: mol_type = other DNA
atgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaagatagaccactggaacaatgagaaggagagaattctactggtcacagacaagactctcttgatctgcaaatacgacttcatcatgctgagttgtgtgcagctgcagcggattcctctgagcgctgtctatcgcatctgcctgggcaagttcaccttccctgggatgtccctggacaaggcagttcctctgcacatgctcttttgcttgccaccatgtaagacgtccctttgctcctccttcaccttccgctatgattataaggcctccccagccacttagaaccgtgagtccattaaacttttttctttataaattacctagtcttgggtatttcttcatagcagtataaaaagggagtaataca

SEQ ID NO: 1411 - DNA, 449 bp, synthetic construct
  misc_feature 1..449: note = Synthetic polypeptide
  source 1..449: mol_type = other DNA
cattgagactgccatggaagacttgaaaggtcacgtagctgagacttctggagagaccattcaaggcttctggctcttgacaaagatagaccactggaacaatgagaaggagagaattctactggtcacagacaagactctcttgatctgcaaatacgacttcatcatgctgagttgtgtgcagctgcagcggattcctctgagcgctgtctatcgcatctgcctgggcaagttcaccttccctgggatgtccctggacaaggcagttcctctgcacatgctcttttgcttgccaccatgtaagacgtccctttgctcctccttcaccttccgctatgattataaggcctccccagccacttagaaccgtgagtccattaaacttttttctttataaattacctagtcttgggtatttcttcatagcagtataaaaagggagtaataca

SEQ ID NO: 1412 - DNA, 729 bp, synthetic construct; identical to SEQ ID NO: 202
  misc_feature 1..729: note = Synthetic polypeptide
  source 1..729: mol_type = other DNA

SEQ ID NO: 1413 - DNA, 644 bp, synthetic construct
  misc_feature 1..644: note = Synthetic polypeptide
  source 1..644: mol_type = other DNA
atgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagaaatttggatacagagacatgcatacagaaggaatgccatgtgagcaggaagcagagtgtgatcgtgcagcagaagccaaggaatgctcaaggttgtcagcaaacacactggatgacaggcacggaaaagattctccttcacagccctcggaaggaaccaaccctgccaacaccttgatctcagatctctaccctccagatctgtgagacaataaattgactgtttaagccactcaatgtgtggtgctttttatgacagctctagcaaaccaataca

SEQ ID NO: 1414 - DNA, 579 bp, synthetic construct
  misc_feature 1..579: note = Synthetic polypeptide
  source 1..579: mol_type = other DNA
aaacatccagaatacatttccaacaagagcactggccaagtcaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagaaatttggatacagagacatgcatacagaaggaatgccatgtgagcaggaagcagagtgtgatcgtgcagcagaagccaaggaatgctcaaggttgtcagcaaacacactggatgacaggcacggaaaagattctccttcacagccctcggaaggaaccaaccctgccaacaccttgatctcagatctctaccctccagatctgtgagacaataaattgactgtttaagccactcaatgtgtggtgctttttatgacagctctagcaaaccaataca

SEQ ID NO: 1415 - DNA, 3157 bp, synthetic construct
  misc_feature 1..3157: note = Synthetic polypeptide
  source 1..3157: mol_type = other DNA
atgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcaacactggaagccagaagacagtggagcagtgccttcagaatttgatggaaaagaaaatcttcaaagaatttcatacctagccaaaccatcaaacaagtacaatggcagcatgaaagtattttccaacttgcaaggtctcctagagtttacctcagatacaactttctcaagaactgctacaggatgtcttataacaaaacatgggattaagccaaagatccaccccaacagagatgcaaagtgatgtcccagaacaataactgtgcagagcagtagttagtctagatgggagcagtaatacaaagggttctaggataccagctccaggaaaaataaatggaactgagagattaccactaagtatgactgtaattgaggtgatttttacaattctgttgcagaatttgactatggctttgagacaaatatagagaaaacaaagcaaacaagaacacgaggtgattcacttttgcaaaataaaaataagtcgtaagaatggagatgcaatc

SEQ ID NO: 1416 - DNA, 1375 bp, synthetic construct
  misc_feature 1..1375: note = Synthetic polypeptide
  source 1..1375: mol_type = other DNA
atggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcaacactggaagccagaagacagtggagcagtgccttcagaatttgatggaaaagaaaatcttcaaagaatttcatacctagccaaaccatcaaacaagtacaatggcagcatgaaagtattttccaacttgcaaggtctcctagagtttacctcagatacaactttctcaagaactgctacaggatgtcttataacaaaacatgggattaagccaaagatccaccccaacagagatgcaaagtgatgtcccagaacaataactgtgcagagcagtagttagtctagatgggagcagtaatacaaagggttctaggataccagctccaggaaaaataaatggaactgagagattaccactaagtatgactgtaattgaggtgatttttacaattctgttgcagaatttgactatggctttgagacaaatatagagaaaacaaagcaaacaagaacacgaggtgattcacttttgcaaaataaaaataagtcgtaagaatggagatgcaatc

SEQ ID NO: 1417 - DNA, 2851 bp, synthetic construct
  misc_feature 1..2851: note = Synthetic polypeptide
  source 1..2851: mol_type = other DNA
atgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcaacactggaagccagaagacagtggagcagtgccttcagaatttgatggaaaagaaaatcttcaaagaatttcatacctagccaaaccatcaaacaagtacaatggcagcatgaaagtattttccaacttgcaaggtctcctagagtttacctcagatacaactttctcaagaactgctacaggatgtcttataacaaaacatgggattaagccaaagatccaccccaacagagatgcaaagtgatgtcccagaacaataactgtgcagagcagtagttagtctagatgggagcagtaatacaaagggttctaggataccagctccaggaaaaataaatggaactgagagattaccactaagtatgactgtaattgaggtgatttttacaattctgttgcagaatttgactatggctttgagacaaatatagagaaaacaaagcaaacaagaacacgaggtgattcacttttgcaaaataaaaataagtcgtaagaatggagatgcaatc

SEQ ID NO: 1418 - DNA, 604 bp, synthetic construct; identical to SEQ ID NO: 1194
  misc_feature 1..604: note = Synthetic polypeptide
  source 1..604: mol_type = other DNA

SEQ ID NO: 1419 - DNA, 364 bp, synthetic construct; identical to SEQ ID NO: 1195
  misc_feature 1..364: note = Synthetic polypeptide
  source 1..364: mol_type = other DNA

SEQ ID NO: 1420 - DNA, 565 bp, synthetic construct
  misc_feature 1..565: note = Synthetic polypeptide
  source 1..565: mol_type = other DNA
atgccaggaacccctggaagcctagaaatgggactgttgacatttagggatgtggccatagaattctctccggaggagtggcaatgtctggacactgcacagcagaatttatataggaatgtgatgttagagaactacagaaacctggccttcctgggtattgctctctctaagccagacctgattacttatctggagcaaggaaaagagccctggaatatgaagcaacatgagatggtggatgaacccacagggcccagacagaagagaagagtcacatcatctagatgatgaatgaaaagatatgtcattattctcctttgggcagtgcttctgcagaaaagttgcaccttctaggtgttggactcagcaatatatcacaatgtctgcagtattttggaaggagaggagagtcaccattacttaggtgctaggcccagcaatacatctcaagcacttcttgggcaaagcccaagcagtaaaaaagagtcacattacctaggttctgggtatagcaatatgtcacaaatgcccctaagaagagggcccaggaaaagagagtcac

SEQ ID NO: 1421 - DNA, 64 bp, synthetic construct
  misc_feature 1..64: note = Synthetic polypeptide
  source 1..64: mol_type = other DNA
atgcttcgcaaagttggtgagttccatgaggagactgcaacttctccaccctgtgcccctccag

SEQ ID NO: 1422 - DNA, 1068 bp, synthetic construct; identical to SEQ ID NO: 1221
  misc_feature 1..1068: note = Synthetic polypeptide
  source 1..1068: mol_type = other DNA

SEQ ID NO: 1423 - DNA, 847 bp, synthetic construct
  misc_feature 1..847: note = Synthetic polypeptide
  source 1..847: mol_type = other DNA
atgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacagttgagcatctcaagtcagaaatccgaaatactcaaatgcgcatttcctttgagtgacgtgtctgtgttcaaaaagttgaggatttcagagcattttggatttgggatgttccacctgtatgtat

SEQ ID NO: 1424 - DNA, 793 bp, synthetic construct
  misc_feature 1..793: note = Synthetic polypeptide
  source 1..793: mol_type = other DNA
atggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacagttgagcatctcaagtcagaaatccgaaatactcaaatgcgcatttcctttgagtgacgtgtctgtgttcaaaaagttgaggatttcagagcattttggatttgggatgttccacctgtatgtat

SEQ ID NO: 1425 - DNA, 418 bp, synthetic construct
  misc_feature 1..418: note = Synthetic polypeptide
  source 1..418: mol_type = other DNA
atggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagaacttgctaccgggattcctacagttgagcatctcaagtcagaaatccgaaatactcaaatgcgcatttcctttgagtgacgtgtctgtgttcaaaaagttgaggatttcagagcattttggatttgggatgttccacctgtatgtat

SEQ ID NO: 1426 - DNA, 798 bp, synthetic construct
  misc_feature 1..798: note = Synthetic polypeptide
  source 1..798: mol_type = other DNA
ttttccggccattgctgccgcggcgcctggcaccagttacctccccgccgccgctcgcacccacgtgcggccgctcccgacgcgcccccgtccaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacagttgagcatctcaagtcagaaatccgaaatactcaaatgcgcatttcctttgagtgacgtgtctgtgttcaaaaagttgaggatttcagagcattttggatttgggatgttccacctgtatgtat

SEQ ID NO: 1427 - DNA, 803 bp, synthetic construct; identical to SEQ ID NO: 152
  misc_feature 1..803: note = Synthetic polypeptide
  source 1..803: mol_type = other DNA

SEQ ID NO: 1428 - DNA, 1296 bp, synthetic construct
  misc_feature 1..1296: note = Synthetic polypeptide
  source 1..1296: mol_type = other DNA
atggccgacaaggaagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1429 - DNA, 1299 bp, synthetic construct
  misc_feature 1..1299: note = Synthetic polypeptide
  source 1..1299: mol_type = other DNA
atggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1430 - DNA, 543 bp, synthetic construct
  misc_feature 1..543: note = Synthetic polypeptide
  source 1..543: mol_type = other DNA
atgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1431 - DNA, 1194 bp, synthetic construct
  misc_feature 1..1194: note = Synthetic polypeptide
  source 1..1194: mol_type = other DNA
atgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1432 - DNA, 706 bp, synthetic construct
  misc_feature 1..706: note = Synthetic polypeptide
  source 1..706: mol_type = other DNA
gaacccttgtatcatcgcaacaaagactccttccagtgatgttcttgtttttgactatacaaaacatccttctaaaccagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1433 - DNA, 578 bp, synthetic construct
  misc_feature 1..578: note = Synthetic polypeptide
  source 1..578: mol_type = other DNA
ctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1434 - DNA, 564 bp, synthetic construct
  misc_feature 1..564: note = Synthetic polypeptide
  source 1..564: mol_type = other DNA
gttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1435 - DNA, 513 bp, synthetic construct
  misc_feature 1..513: note = Synthetic polypeptide
  source 1..513: mol_type = other DNA
tccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1436 - DNA, 1072 bp, synthetic construct; identical to SEQ ID NO: 307
  misc_feature 1..1072: note = Synthetic polypeptide
  source 1..1072: mol_type = other DNA

SEQ ID NO: 1437 - DNA, 763 bp, synthetic construct; identical to SEQ ID NO: 261
  misc_feature 1..763: note = Synthetic polypeptide
  source 1..763: mol_type = other DNA

SEQ ID NO: 1438 - DNA, 646 bp, synthetic construct; identical to SEQ ID NO: 262
  misc_feature 1..646: note = Synthetic polypeptide
  source 1..646: mol_type = other DNA

SEQ ID NO: 1439 - DNA, 2505 bp, synthetic construct
  misc_feature 1..2505: note = Synthetic polypeptide
  source 1..2505: mol_type = other DNA
atggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1440 - DNA, 2398 bp, synthetic construct
  misc_feature 1..2398: note = Synthetic polypeptide
  source 1..2398: mol_type = other DNA
atatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1441 - DNA, 2367 bp, synthetic construct
  misc_feature 1..2367: note = Synthetic polypeptide
  source 1..2367: mol_type = other DNA
atggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1442 - DNA, 1389 bp, synthetic construct
  misc_feature 1..1389: note = Synthetic polypeptide
  source 1..1389: mol_type = other DNA
atgaaataccaggaggtcagatgtttaacctctttcaacatatctgtttcttttcctgcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1443 - DNA, 2637 bp, synthetic construct
  misc_feature 1..2637: note = Synthetic polypeptide
  source 1..2637: mol_type = other DNA
atgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1444 - DNA, 1521 bp, synthetic construct
  misc_feature 1..1521: note = Synthetic polypeptide
  source 1..1521: mol_type = other DNA
attgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1445 - DNA, 1509 bp, synthetic construct
  misc_feature 1..1509: note = Synthetic polypeptide
  source 1..1509: mol_type = other DNA
atggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1446 - DNA, 435 bp, synthetic construct
  misc_feature 1..435: note = Synthetic polypeptide
  source 1..435: mol_type = other DNA
atgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1447 - DNA, 1599 bp, synthetic construct
  misc_feature 1..1599: note = Synthetic polypeptide
  source 1..1599: mol_type = other DNA
gcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1448 - DNA, 1736 bp, synthetic construct; identical to SEQ ID NO: 156
  misc_feature 1..1736: note = Synthetic polypeptide
  source 1..1736: mol_type = other DNA

SEQ ID NO: 1449 - DNA, 1724 bp, synthetic construct; identical to SEQ ID NO: 157
  misc_feature 1..1724: note = Synthetic polypeptide
  source 1..1724: mol_type = other DNA

SEQ ID NO: 1450 - DNA, 303 bp, synthetic construct; identical to SEQ ID NO: 148
  misc_feature 1..303: note = Synthetic polypeptide
  source 1..303: mol_type = other DNA

SEQ ID NO: 1451 - DNA, 301 bp, synthetic construct; identical to SEQ ID NO: 147
  misc_feature 1..301: note = Synthetic polypeptide
  source 1..301: mol_type = other DNA

SEQ ID NO: 1452 - DNA, 389 bp, synthetic construct
  misc_feature 1..389: note = Synthetic polypeptide
  source 1..389: mol_type = other DNA
atgacactggcaactgacggcactgcggatatgtttggaataaggttcaaaagaagaggctgttctaagaaagactaccgagtaatcaatcacctcctcagagaaagtctgctcaggtggatacgtgtcatttgaattggtgaaaacccacagaatgcacaacatgaaaagtaagcagcaaatgatggagggacattaatatcaatgtatccaatattggcatatcaaatcttaacaaacaaacaggccacaataatacaaaacgttactaacagaggaaactggcaggaagtcaggaggagaagggcatgtatgagaactctgtactttctgccccatttttctgtaaacttcaaactgctctaaaaaataaagtctagtaatttttt

SEQ ID NO: 1453 - DNA, 1339 bp, synthetic construct
  misc_feature 1..1339: note = Synthetic polypeptide
  source 1..1339: mol_type = other DNA
atgagtagaatgagacctgtgtgccaaccctggcctagtcctcatgcccccacaactgtgaagcgagagggctcaacagtttcgaattcaattcaaccaccacctcctgaataccaactaggttccaggacctggctagaagcagagacaccaggacagaaaagacagtgttctgctttcatggagttcacagaagagtcgaggagccgaagctggactgtactgctgccatctcggctcactgcagcctccctgcctgattctcctgcctcagcctgccaagtgcctgcgattgcaggcgcgcgccgccacgcctgactgcttttcgtatttttttggtggagacggggtttcgctgtgttggctgggctggtctccagctcctaaccgcgagtgatccgccagcctcggcctcctgaggtgccaggattgcagacggagtctggttcactcagtgctcaatggggcccaggctggagtgcagtggcgtgatctcggctcgctacaacctccacctcccagccgcctgccttggcctcccaaagtgccgagattgcagcctctgcccggctgccaccccgtctgggaagtgaggagcgtctctgcctggccgcccatcgtctgggacgtgaggagccccactgcctggctacccagtctggaaagtgaggagcgtctctgcccggccaccatcccatctaggaagtgaggagcgcctcttccctgcggccatcccgtctaggaagtgaggagcgcctcttccctgcggccatcccatctaggaagtgaggagcgtctctgcccggccgccatcccgtctaggaagtgaggagcgtctctgcccggccgccatcccgtctaggaagtgaggagcgtctctgcccggccgccatcccgtctaggaagtgaggagcgtctctgcccggcagccatcccgtctaggaagtgaggagcgtctctgcccggccgccatcccgtctaggaagtgaggagcacctcttcccggccgccatcccgtctaggaagtgaggagcgcctcttcccggccgccatcccatctaggaagtgaggagcgtctctgcccggcggcccatcatctgagatgtggggagcgcctctgccccgccgccccgtctgggatgtgaggagcgcctctacccagctgcgaccccgtctgggaggtgaggagcgtctctgcccagccgccccgtctgagaagtgaggagaccctctgcctggcaaccgccccatatgagaagtgaggagcccctccgcccggcagccaccccgtctgggaagtgaggagtgtctctgcctggcagccaccccatccgggagg

SEQ ID NO: 1454 - DNA, 857 bp, synthetic construct
  misc_feature 1..857: note = Synthetic polypeptide
  source 1..857: mol_type = other DNA
atgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggttctgctagcgttccgactcacaagactaccgtagaccacgcgtggcatcgtgttcacttagaaggacacaggacaggaaatacagcttgacagcagatcagcatccggcaaccctcttcagtggaagtaatcccagtagcagtccacgtaattttccaggacctcctacccagtccgcaacccccagacgattctagtatgagggaacaaggctcatgtcaaacagatggaggatctgccttggcctagcagcctcaataccccataggagactaaatctattataacaactccacaatcataacttccagggtctcttcaaatgaagtcaccacattcagggaagctcaaagttatggctttccattaggtatttataattcttagatagaattcccaggccagaagtcatttatcaatcaggggtcatttttaccataagcggtgttgccagataatacaattgacacacctttgtcaggtttcctggagaa

SEQ ID NO: 1455 - DNA, 749 bp, synthetic construct
  misc_feature 1..749: note = Synthetic polypeptide
  source 1..749: mol_type = other DNA
tactgcagagacatccacaccaaatacagcagtgaatggggagctggagcactggaagataaaagcaggctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggttctgctagcgttccgactcacaagactaccgtagaccacgcgtggcatcgtgttcacttagaaggacacaggacaggaaatacagcttgacagcagatcagcatccggcaaccctcttcagtggaagtaatcccagtagcagtccacgtaattttccaggacctcctacccagtccgcaacccccagacgattctagtatgagggaacaaggctcatgtcaaacagatggaggatctgccttggcctagcagcctcaataccccataggagactaaatctattataacaactccacaatcataacttccagggtctcttcaaatgaagtcaccacattcagggaagctcaaagttatggctttccattaggtatttataattcttagatagaattcccaggccagaagtcatttatcaatcaggggtcatttttaccataagcggtgttgccagataatacaattgacacacctttgtcaggtttcctggagaa

SEQ ID NO: 1456 - DNA, 773 bp, synthetic construct
  misc_feature 1..773: note = Synthetic polypeptide
  source 1..773: mol_type = other DNA
atgagtatggaagattatgatttcctgttcaaaattgttttaattggcaacgctggtgtggggaagacgtgcctcgtccgaagattcactcagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggttctgctagcgttccgactcacaagactaccgtagaccacgcgtggcatcgtgttcacttagaaggacacaggacaggaaatacagcttgacagcagatcagcatccggcaaccctcttcagtggaagtaatcccagtagcagtccacgtaattttccaggacctcctacccagtccgcaacccccagacgattctagtatgagggaacaaggctcatgtcaaacagatggaggatctgccttggcctagcagcctcaataccccataggagactaaatctattataacaactccacaatcataacttccagggtctcttcaaatgaagtcaccacattcagggaagctcaaagttatggctttccattaggtatttataattcttagatagaattcccaggccagaagtcatttatcaatcaggggtcatttttaccataagcggtgttgccagataatacaattgacacacctttgtcaggtttcctggagaa

SEQ ID NO: 1457 - DNA, 719 bp, synthetic construct
  misc_feature 1..719: note = Synthetic polypeptide
  source 1..719: mol_type = other DNA
atgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggttctgctagcgttccgactcacaagactaccgtagaccacgcgtggcatcgtgttcacttagaaggacacaggacaggaaatacagcttgacagcagatcagcatccggcaaccctcttcagtggaagtaatcccagtagcagtccacgtaattttccaggacctcctacccagtccgcaacccccagacgattctagtatgagggaacaaggctcatgtcaaacagatggaggatctgccttggcctagcagcctcaataccccataggagactaaatctattataacaactccacaatcataacttccagggtctcttcaaatgaagtcaccacattcagggaagctcaaagttatggctttccattaggtatttataattcttagatagaattcccaggccagaagtcatttatcaatcaggggtcatttttaccataagcggtgttgccagataatacaattgacacacctttgtcaggtttcctggagaa

SEQ ID NO: 1458 - DNA, 2161 bp, synthetic construct; identical to SEQ ID NO: 288
  misc_feature 1..2161: note = Synthetic polypeptide
  source 1..2161: mol_type = other DNA

SEQ ID NO: 1459 - DNA, 2140 bp, synthetic construct; identical to SEQ ID NO: 289
  misc_feature 1..2140: note = Synthetic polypeptide
  source 1..2140: mol_type = other DNA

SEQ ID NO: 1460 - DNA, 529 bp, synthetic construct; identical to SEQ ID NO: 287
  misc_feature 1..529: note = Synthetic polypeptide
  source 1..529: mol_type = other DNA

SEQ ID NO: 1461 - DNA, 2912 bp, synthetic construct
  misc_feature 1..2912: note = Synthetic polypeptide
  source 1..2912: mol_type = other DNA
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcaggactgcaaggggcctactctgtcacctgtggctcttcctctcctctcaggaacaaacaacaaaaatcaaatgactctgcttttggggatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccatctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaaggatagaaatcacatttagaaggtgcacatgaggctgctacagacgggccctctga

SEQ ID NO: 1462 - DNA, 2825 bp, synthetic construct
  misc_feature 1..2825: note = Synthetic polypeptide
  source 1..2825: mol_type = other DNA
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcagatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccatctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaaggatagaaatcacatttagaaggtgcacatgaggctgctacagacgggccctctga

SEQ ID NO: 1463 - DNA, 2249 bp, synthetic construct
  misc_feature 1..2249: note = Synthetic polypeptide
  source 1..2249: mol_type = other DNA
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccatctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaacttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaaggatagaaatcacatttagaaggtgcacatgaggctgctacagacgggccctctga

SEQ ID NO: 1464 - DNA, 2741 bp, synthetic construct
  misc_feature 1..2741: note = Synthetic polypeptide
  source 1..2741: mol_type = other DNA
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcaggactgcaaggggcctactctgtcacctgtggctcttcctctcctctcaggaacaaacaacaaaaatcaaatgactctgcttttggggatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtggtctgtgtcaacctggtgaatattctgcagatggctttgcaccttgccatctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaaggatagaaatcacatttagaaggtgcacatgaggctgctacagacgggccctctga

SEQ ID NO: 1465 - DNA, 387 bp, synthetic construct
  misc_feature 1..387: note = Synthetic polypeptide
  source 1..387: mol_type = other DNA
gggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaaggatagaaatcacatttagaaggtgcacatgaggctgctacagacgggccctctga

SEQ ID NO: 1466 - DNA, 373 bp, synthetic construct
  misc_feature 1..373: note = Synthetic polypeptide
  source 1..373: mol_type = other DNA
ggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaaggatagaaatcacatttagaaggtgcacatgaggctgctacagacgggccctctga

SEQ ID NO: 1467 - DNA, 15330 bp, synthetic construct
  misc_feature 1..15330: note = Synthetic polypeptide
  source 1..15330: mol_type = other DNA
atgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggccgggtgtggtggctgacagctgtaatcccagcactttgggaggccaaggcgggtgaatcaccccaggtcaagagttcaagaccatccagcctgatgaacatggtgaaaccccgtctctactgaaaatacaaaaattagccagctgtggtggcgcatgcctgtaatcccagctacttgggaggccgaggcaggagaatcgcgtgaacccgggaggtggaggttgcagtgagccgggatcgcaccactgcactccagcctgggcaacaagagtgaaactccgtcttaaataaataaataaataaaaataaaataaaaaataaat

SEQ ID NO: 1468 - DNA, 15330 bp, synthetic construct
  misc_feature 1..15330: note = Synthetic polypeptide
  source 1..15330: mol_type = other DNA
atgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggcgggagatatacagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtaggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggccgggtgtggtggctgacagctgtaatcccagcactttgggaggccaaggcgggtgaatcaccccaggtcaagagttcaagaccatccagcctgatgaacatggtgaaaccccgtctctactgaaaatacaaaaattagccagctgtggtggcgcatgcctgtaatcccagctacttgggaggccgaggcaggagaatcgcgtgaacccgggaggtggaggttgcagtgagccgggatcgcaccactgcactccagcctgggcaacaagagtgaaactccgtcttaaataaataaataaataaaaataaaataaaaaataaat

SEQ ID NO: 1469 - DNA, 15345 bp, synthetic construct
  misc_feature 1..15345: note = Synthetic polypeptide
  source 1..15345: mol_type = other DNA
atgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggcgggagatatacagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggccgggtgtggtggctgacagctgtaatcccagcactttgggaggccaaggcgggtgaatcaccccaggtcaagagttcaagaccatccagcctgatgaacatggtgaaaccccgtctctactgaaaatacaaaaattagccagctgtggtggcgcatgcctgtaatcccagctacttgggaggccgaggcaggagaatcgcgtgaacccgggaggtggaggttgcagtgagccgggatcgcaccactgcactccagcctgggcaacaagagtgaaactccgtcttaaataaataaataaataaaaataaaataaaaaataaat

SEQ ID NO: 1470 - DNA, 193 bp, synthetic construct; identical to SEQ ID NO: 975
  misc_feature 1..193: note = Synthetic polypeptide
  source 1..193: mol_type = other DNA

SEQ ID NO: 1471 - DNA, 1221 bp, synthetic construct; identical to SEQ ID NO: 122
  misc_feature 1..1221: note = Synthetic polypeptide
  source 1..1221: mol_type = other DNA

SEQ ID NO: 1472 - DNA, 303 bp, synthetic construct; identical to SEQ ID NO: 148
  misc_feature 1..303: note = Synthetic polypeptide
  source 1..303: mol_type = other DNA

SEQ ID NO: 1473 - DNA, 301 bp, synthetic construct; identical to SEQ ID NO: 147
  misc_feature 1..301: note = Synthetic polypeptide
  source 1..301: mol_type = other DNA

SEQ ID NO: 1474 - DNA, 3992 bp, synthetic construct; identical to SEQ ID NO: 120
  misc_feature 1..3992: note = Synthetic polypeptide
  source 1..3992: mol_type = other DNA

SEQ ID NO: 1475 - DNA, 3845 bp, synthetic construct; identical to SEQ ID NO: 121
  misc_feature 1..3845: note = Synthetic polypeptide
  source 1..3845: mol_type = other DNA

SEQ ID NO: 1476 - DNA, 371 bp, synthetic construct; identical to SEQ ID NO: 1008
  misc_feature 1..371: note = Synthetic polypeptide
  source 1..371: mol_type = other DNA

SEQ ID NO: 1477 - DNA, 272 bp, synthetic construct; identical to SEQ ID NO: 1009
  misc_feature 1..272: note = Synthetic polypeptide
  source 1..272: mol_type = other DNA

SEQ ID NO: 1478 - DNA, 999 bp, synthetic construct; identical to SEQ ID NO: 983
  misc_feature 1..999: note = Synthetic polypeptide
  source 1..999: mol_type = other DNA

SEQ ID NO: 1479 - DNA, 317 bp, synthetic construct; identical to SEQ ID NO: 995
  misc_feature 1..317: note = Synthetic polypeptide
  source 1..317: mol_type = other DNA

SEQ ID NO: 1480 - DNA, 639 bp, synthetic construct; identical to SEQ ID NO: 1176
  misc_feature 1..639: note = Synthetic polypeptide
  source 1..639: mol_type = other DNA

SEQ ID NO: 1481 - DNA, 2409 bp, synthetic construct
  misc_feature 1..2409: note = Synthetic polypeptide
  source 1..2409: mol_type = other DNA
atgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagatacaaaaattagccgggcatggtggcacgcacctgtagtcccagctacttgtgaggctgaggcaggagaatcgcttgaatccgggaggcggaggttgcagtgagccgagatcatgccacttcactccagcctgagtgacagagtgagtctccgtctaaaaaaaaaaaacagaaactagaaaagaa

SEQ ID NO: 1482 - DNA, 603 bp, synthetic construct; identical to SEQ ID NO: 1012
  misc_feature 1..603: note = Synthetic polypeptide
  source 1..603: mol_type = other DNA

SEQ ID NO: 1483 - DNA, 1834 bp, synthetic construct; identical to SEQ ID NO: 133
  misc_feature 1..1834: note = Synthetic polypeptide
  source 1..1834: mol_type = other DNA

SEQ ID NO: 1484 - DNA, 1765 bp, synthetic construct; identical to SEQ ID NO: 135
  misc_feature 1..1765: note = Synthetic polypeptide
  source 1..1765: mol_type = other DNA

SEQ ID NO: 1485 - DNA, 610 bp, synthetic construct; identical to SEQ ID NO: 163
  misc_feature 1..610: note = Synthetic polypeptide
  source 1..610: mol_type = other DNA

SEQ ID NO: 1486 - DNA, 703 bp, synthetic construct
  misc_feature 1..703: note = Synthetic polypeptide
  source 1..703: mol_type = other DNA
atgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggctctctttttgcctgctgccatccatgtaagacgcgacttgtttctccttgccttctgtcatgattgtgaggcttccccagacacttggaactgtaagtccattaaacctctcttcttttgtaaattacccagtcttgagtatgtctttatcagcagtgtgaaaatggactaataca

SEQ ID NO: 1487 - DNA, 1015 bp, synthetic construct
  misc_feature 1..1015: note = Synthetic polypeptide
  source 1..1015: mol_type = other DNA
atgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggctctctttttgcctgctgccatccatgtaagacgcgacttgtttctccttgccttctgtcatgattgtgaggcttccccagacacttggaactgtaagtccattaaacctctcttcttttgtaaattacccagtcttgagtatgtctttatcagcagtgtgaaaatggactaataca

SEQ ID NO: 1488 - DNA, 844 bp, synthetic construct
  misc_feature 1..844: note = Synthetic polypeptide
  source 1..844: mol_type = other DNA
atgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattttgatccgatttcaaatccagaggaatgtgatagtgatccccggatctatcaccccaagtcacattaaagagaatatccaggctctctttttgcctgctgccatccatgtaagacgcgacttgtttctccttgccttctgtcatgattgtgaggcttccccagacacttggaactgtaagtccattaaacctctcttcttttgtaaattacccagtcttgagtatgtctttatcagcagtgtgaaaatggactaataca

SEQ ID NO: 1489 - DNA, 721 bp, synthetic construct
  misc_feature 1..721: note = Synthetic polypeptide
  source 1..721: mol_type = other DNA
atgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggagattttgatccgatttcaaatccagaggaatgtgatagtgatccccggatctatcaccccaagtcacattaaagagaatatccaggctctctttttgcctgctgccatccatgtaagacgcgacttgtttctccttgccttctgtcatgattgtgaggcttccccagacacttggaactgtaagtccattaaacctctcttcttttgtaaattacccagtcttgagtatgtctttatcagcagtgtgaaaatggactaataca

SEQ ID NO: 1490 - DNA, 1398 bp, synthetic construct; identical to SEQ ID NO: 948
  misc_feature 1..1398: note = Synthetic polypeptide
  source 1..1398: mol_type = other DNA

SEQ ID NO: 1491 - DNA, 1302 bp, synthetic construct; identical to SEQ ID NO: 949
  misc_feature 1..1302: note = Synthetic polypeptide
  source 1..1302: mol_type = other DNA

SEQ ID NO: 1492 - DNA, 487 bp, synthetic construct; identical to SEQ ID NO: 918
  misc_feature 1..487: note = Synthetic polypeptide
  source 1..487: mol_type = other DNA

SEQ ID NO: 1493 - DNA, 170 bp, synthetic construct
  misc_feature 1..170: note = Synthetic polypeptide
  source 1..170: mol_type = other DNA
atggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaaggtgtaattattatt

SEQ ID NO: 1494 - DNA, 8343 bp, synthetic construct
  misc_feature 1..8343: note = Synthetic polypeptide
  source 1..8343: mol_type = other DNA
atgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagggaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggagcgccttgcagtctaaggagagcccatgcctttggacatgctgttccttctgcctggaatttccttgtccgcctggtgaactcctcgttctgcaagactccgctcaaaacagcaccttcgagaagactgccctgccccttccctgccttgccccatgtccccctcccttgggtccccagagccacgcacatccagccctgcttcccacacacggggccgtgcgtgcctttcttcaccactgagctccttcaagggcagggactgtctttatctttgcatcccccgctgcaccctgtgcctgcccactgggcactcggtggatg

SEQ ID NO: 1495 - DNA, 434 bp, synthetic construct; identical to SEQ ID NO: 992
  misc_feature 1..434: note = Synthetic polypeptide
  source 1..434: mol_type = other DNA

SEQ ID NO: 1496 - DNA, 822 bp, synthetic construct; identical to SEQ ID NO: 119
  misc_feature 1..822: note = Synthetic polypeptide
  source 1..822: mol_type = other DNA

SEQ ID NO: 1497 - DNA, 1731 bp, synthetic construct; identical to SEQ ID NO: 989
  misc_feature 1..1731: note = Synthetic polypeptide
  source 1..1731: mol_type = other DNA

SEQ ID NO: 1498 - DNA, 2262 bp, synthetic construct; identical to SEQ ID NO: 990
  misc_feature 1..2262: note = Synthetic polypeptide
  source 1..2262: mol_type = other DNA

SEQ ID NO: 1499 - DNA, 2253 bp, synthetic construct; identical to SEQ ID NO: 991
  misc_feature 1..2253: note = Synthetic polypeptide
  source 1..2253: mol_type = other DNA

SEQ ID NO: 1500 - DNA, 157 bp, synthetic construct
  misc_feature 1..157: note = Synthetic polypeptide
  source 1..157: mol_type = other DNA
atgtaccaggtgagcggccagcgcccctctggctgcgacgcgccctatggagcccccagcgcagccccgggcccaggtctgttcctgaacctctgacacgaactccctgccttgccttggacaagctccttcccttctctggcctgagcctccacat

SEQ ID NO: 1501 - DNA, 1146 bp, synthetic construct; identical to SEQ ID NO: 988
  misc_feature 1..1146: note = Synthetic polypeptide
  source 1..1146: mol_type = other DNA

SEQ ID NO: 1502 - DNA, 2154 bp, synthetic construct
  misc_feature 1..2154: note = Synthetic polypeptide
  source 1..2154: mol_type = other DNA
atgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaatggggataatggaatctgcctcctgggactgtcacgagaattagatgag

SEQ ID NO: 1503 - DNA, 2025 bp, synthetic construct
  misc_feature 1..2025: note = Synthetic polypeptide
  source 1..2025: mol_type = other DNA
atgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaatggggataatggaatctgcctcctgggactgtcacgagaattagatgag

SEQ ID NO: 1504 - DNA, 1394 bp, synthetic construct; identical to SEQ ID NO: 1118
  misc_feature 1..1394: note = Synthetic polypeptide
  source 1..1394: mol_type = other DNA

SEQ ID NO: 1505 - DNA, 1625 bp, synthetic construct; identical to SEQ ID NO: 1119
  misc_feature 1..1625: note = Synthetic polypeptide
  source 1..1625: mol_type = other DNA

SEQ ID NO: 1506 - DNA, 1505 bp, synthetic construct; identical to SEQ ID NO: 1120
  misc_feature 1..1505: note = Synthetic polypeptide
  source 1..1505: mol_type = other DNA

SEQ ID NO: 1507 - DNA, 1562 bp, synthetic construct; identical to SEQ ID NO: 1121
  misc_feature 1..1562: note = Synthetic polypeptide
  source 1..1562: mol_type = other DNA

SEQ ID NO: 1508 - DNA, 1601 bp, synthetic construct; identical to SEQ ID NO: 1122
  misc_feature 1..1601: note = Synthetic polypeptide
  source 1..1601: mol_type = other DNA

SEQ ID NO: 1509 - DNA, 1631 bp, synthetic construct; identical to SEQ ID NO: 1123
  misc_feature 1..1631: note = Synthetic polypeptide
  source 1..1631: mol_type = other DNA

SEQ ID NO: 1510 - DNA, 763 bp, synthetic construct; identical to SEQ ID NO: 261
  misc_feature 1..763: note = Synthetic polypeptide
  source 1..763: mol_type = other DNA

SEQ ID NO: 1511 - DNA, 646 bp, synthetic construct; identical to SEQ ID NO: 262
  misc_feature 1..646: note = Synthetic polypeptide
  source 1..646: mol_type = other DNA

SEQ ID NO: 1512 - DNA, 750 bp, synthetic construct; identical to SEQ ID NO: 1060
  misc_feature 1..750: note = Synthetic polypeptide
  source 1..750: mol_type = other DNA

SEQ ID NO: 1513 - DNA, 296 bp, synthetic construct; identical to SEQ ID NO: 1061
  misc_feature 1..296: note = Synthetic polypeptide
  source 1..296: mol_type = other DNA

SEQ ID NO: 1514 - DNA, 721 bp, synthetic construct; identical to SEQ ID NO: 414
  misc_feature 1..721: note = Synthetic polypeptide
  source 1..721: mol_type = other DNA

SEQ ID NO: 1515 - DNA, 1052 bp, synthetic construct; identical to SEQ ID NO: 247
  misc_feature 1..1052: note = Synthetic polypeptide
  source 1..1052: mol_type = other DNA

SEQ ID NO: 1516 - DNA, 327 bp, synthetic construct; identical to SEQ ID NO: 246
  misc_feature 1..327: note = Synthetic polypeptide
  source 1..327: mol_type = other DNA

SEQ ID NO: 1517 - DNA, 890 bp, synthetic construct; identical to SEQ ID NO: 319
  misc_feature 1..890: note = Synthetic polypeptide
  source 1..890: mol_type = other DNA

SEQ ID NO: 1518 - DNA, 947 bp, synthetic construct; identical to SEQ ID NO: 320
  misc_feature 1..947: note = Synthetic polypeptide
  source 1..947: mol_type = other DNA

SEQ ID NO: 1519 - DNA, 177 bp, synthetic construct
  misc_feature 1..177: note = Synthetic polypeptide
  source 1..177: mol_type = other DNA
atgaggacagcattgctgctccttgcagccctggctgtggctacagggccagcccttaccctgcgctgccacgtgtgcaccagctccagcaactgcaagcattctgtggtctgcccggccagctctcgcttctgcaagaccacgaacacaggacctggcacaggagggtgcgcatta

SEQ ID NO: 1520 - DNA, 1839 bp, synthetic construct; identical to SEQ ID NO: 1059
  misc_feature 1..1839: note = Synthetic polypeptide
  source 1..1839: mol_type = other DNA

SEQ ID NO: 1521 - DNA, 500 bp, synthetic construct; identical to SEQ ID NO: 204
  misc_feature 1..500: note = Synthetic polypeptide
  source 1..500: mol_type = other DNA

SEQ ID NO: 1522 - DNA, 656 bp, synthetic construct; identical to SEQ ID NO: 205
  misc_feature 1..656: note = Synthetic polypeptide
  source 1..656: mol_type = other DNA

SEQ ID NO: 1523 - DNA, 524 bp, synthetic construct; identical to SEQ ID NO: 207
  misc_feature 1..524: note = Synthetic polypeptide
  source 1..524: mol_type = other DNA

SEQ ID NO: 1524 - DNA, 2557 bp, synthetic construct
  misc_feature 1..2557: note = Synthetic polypeptide
  source 1..2557: mol_type = other DNA
atgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagataccacctctgttgatctgggaactaagaccatgttgcttgtccttagtcacatatgacttaatttgcacccattgtgggccactggtgtcagacaggaagcctaagcgcaggtatcactgaggaggatacacatgctaactacacgatcttcaccagacctgtgagcttccagccaccagatccaaagtcacagagcacagggacttacaaacccagtgctggaaaacatagcaaaggctatatccaatttaggtttctctttattggaaataaagatggcccatacttcaaatatgttatttagagaatgcttataaagagcagcctaaagtcccattctcttgcctgtaagcaacaaaattacaaaaatgttgaatttctaaaatgcgaaagttaagcattccagagaccagctcatggaagaaggttttatgtttttgggtgttgtaac

SEQ ID NO: 1525 - DNA, 2428 bp, synthetic construct
  misc_feature 1..2428: note = Synthetic polypeptide
  source 1..2428: mol_type = other DNA
atgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagataccacctctgttgatctgggaactaagaccatgttgcttgtccttagtcacatatgacttaatttgcacccattgtgggccactggtgtcagacaggaagcctaagcgcaggtatcactgaggaggatacacatgctaactacacgatcttcaccagacctgtgagcttccagccaccagatccaaagtcacagagcacagggacttacaaacccagtgctggaaaacatagcaaaggctatatccaatttaggtttctctttattggaaataaagatggcccatacttcaaatatgttatttagagaatgcttataaagagcagcctaaagtcccattctcttgcctgtaagcaacaaaattacaaaaatgttgaatttctaaaatgcgaaagttaagcattccagagaccagctcatggaagaaggttttatgtttttgggtgttgtaac

SEQ ID NO: 1526 - DNA, 965 bp, synthetic construct; identical to SEQ ID NO: 1035
  misc_feature 1..965: note = Synthetic polypeptide
  source 1..965: mol_type = other DNA

SEQ ID NO: 1527 - DNA, 725 bp, synthetic construct; identical to SEQ ID NO: 1036
  misc_feature 1..725: note = Synthetic polypeptide
  source 1..725: mol_type = other DNA

SEQ ID NO: 1528 - DNA, 2181 bp, synthetic construct
  misc_feature 1..2181: note = Synthetic polypeptide
  source 1..2181: mol_type = other DNA
atgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaaataagaatgatcaaagcgcctgcctcgtacagtggtcatgaggatcgaacgaagagagctatgtggagagcctgg

SEQ ID NO: 1529 - DNA, 2052 bp, synthetic construct
  misc_feature 1..2052: note = Synthetic polypeptide
  source 1..2052: mol_type = other DNA
atgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaaataagaatgatcaaagcgcctgcctcgtacagtggtcatgaggatcgaacgaagagagctatgtggagagcctgg

SEQ ID NO: 1530 - DNA, 609 bp, synthetic construct; identical to SEQ ID NO: 249
  misc_feature 1..609: note = Synthetic polypeptide
  source 1..609: mol_type = other DNA

SEQ ID NO: 1531 - DNA, 738 bp, synthetic construct; identical to SEQ ID NO: 250
  misc_feature 1..738: note = Synthetic polypeptide
  source 1..738: mol_type = other DNA

SEQ ID NO: 1532 - DNA, 537 bp, synthetic construct; identical to SEQ ID NO: 251
  misc_feature 1..537: note = Synthetic polypeptide
  source 1..537: mol_type = other DNA

SEQ ID NO: 1533 - DNA, 684 bp, synthetic construct; identical to SEQ ID NO: 253
  misc_feature 1..684: note = Synthetic polypeptide
  source 1..684: mol_type = other DNA

SEQ ID NO: 1534 - DNA, 285 bp, synthetic construct; identical to SEQ ID NO: 255
  misc_feature 1..285: note = Synthetic polypeptide
  source 1..285: mol_type = other DNA

SEQ ID NO: 1535 - DNA, 552 bp, synthetic construct; identical to SEQ ID NO: 254
  misc_feature 1..552: note = Synthetic polypeptide
  source 1..552: mol_type = other DNA

SEQ ID NO: 1536 - DNA, 1493 bp, synthetic construct
  misc_feature 1..1493: note = Synthetic polypeptide
  source 1..1493: mol_type = other DNA
atggagcagcgccgcgtcaccgacttcttcgcgcgccgccgccccgggcccccccgcatcgcgccgcccaagctggcctgccgcacccccagccccgccaggcccgcactccgcgccccggcctccgctaccagtggcagccgcaagcgcgcccgcccgcccgccgcccccggacgcgaccaggccaggccaccggcccgcaggagactgcggctgtcggtggacgaggtttccagccccagtacccccgaggccccagacatcccagcctgcccttctccgggccagaagataaagaaatccaccccggcagcaggtcagccgccccacctgacatccgcgcaggaccaggacaccatctctgagcttgcgtcatgcctgcaacgggcccgggagctgggggcaagagtccgggcgctgaaggccagtgcccaggatgctggggagtcctgcaccccagaggccgagggccgccctgaggagccatgtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggcgttttgaggagtgcaatgttggccagatcaaaaccgtgtacccggcctcctaccgcttccgccaggagcgcagtgtccccaccttcaaggatggcaccaggaggtcagattaccagctcaccatcgagccactgctggagcaggaggctgacggagcagccccccagctcacggcctcgcgcctcctgcagcgacggcagatcttcagccagaagctggtggagcatgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctgggccttcatgacaggg

SEQ ID NO: 1537 - DNA, 980 bp, synthetic construct; identical to SEQ ID NO: 139
  misc_feature 1..980: note = Synthetic polypeptide
  source 1..980: mol_type = other DNA

SEQ ID NO: 1538 - DNA, 1256 bp, synthetic construct; identical to SEQ ID NO: 140
  misc_feature 1..1256: note = Synthetic polypeptide
  source 1..1256: mol_type = other DNA

SEQ ID NO: 1539 - DNA, 1277 bp, synthetic construct; identical to SEQ ID NO: 142
  misc_feature 1..1277: note = Synthetic polypeptide
  source 1..1277: mol_type = other DNA

SEQ ID NO: 1540 - DNA, 1094 bp, synthetic construct; identical to SEQ ID NO: 153
  misc_feature 1..1094: note = Synthetic polypeptide
  source 1..1094: mol_type = other DNA

SEQ ID NO: 1541 - DNA, 2572 bp, synthetic construct
  misc_feature 1..2572: note = Synthetic polypeptide
  source 1..2572: mol_type = other DNA
atggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagagctgggacacctgccttctgcccttaaacatcagaactccagggtctctcgccttttgactctgggatttgtaccagcagccccccagtgttctcaggccttcagcctgggactgaaagtcttggattgggcaatgctaccagcttcctggttctccagcttgtagatggcttatcctaggacttctcagcctccataatcccatgagtcaatttccctaataagtcccctctcatctctctctgtatatatcctatttgttctgttcttgggagaaccctgactaataca

SEQ ID NO: 1542 - DNA, 2407 bp, synthetic construct
  misc_feature 1..2407: note = Synthetic polypeptide
  source 1..2407: mol_type = other DNA
atgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagagctgggacacctgccttctgcccttaaacatcagaactccagggtctctcgccttttgactctgggatttgtaccagcagccccccagtgttctcaggccttcagcctgggactgaaagtcttggattgggcaatgctaccagcttcctggttctccagcttgtagatggcttatcctaggacttctcagcctccataatcccatgagtcaatttccctaataagtcccctctcatctctctctgtatatatcctatttgttctgttcttgggagaaccctgactaataca

SEQ ID NO: 1543 - DNA, 651 bp, synthetic construct
  misc_feature 1..651: note = Synthetic polypeptide
  source 1..651: mol_type = other DNA
atggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagagctgggacacctgccttctgcccttaaacatcagaactccagggtctctcgccttttgactctgggatttgtaccagcagccccccagtgttctcaggccttcagcctgggactgaaagtcttggattgggcaatgctaccagcttcctggttctccagcttgtagatggcttatcctaggacttctcagcctccataatcccatgagtcaatttccctaataagtcccctctcatctctctctgtatatatcctatttgttctgttcttgggagaaccctgactaataca

SEQ ID NO: 1544 - DNA, 391 bp, synthetic construct
  misc_feature 1..391: note = Synthetic polypeptide
  source 1..391: mol_type = other DNA
gtggttctccgcaatgacgtggcaccaaccatcatcccgacacccatgtaccgtcctcggccagccaacccagatgaaatcggcaactttataattgagagctgggacacctgccttctgcccttaaacatcagaactccagggtctctcgccttttgactctgggatttgtaccagcagccccccagtgttctcaggccttcagcctgggactgaaagtcttggattgggcaatgctaccagcttcctggttctccagcttgtagatggcttatcctaggacttctcagcctccataatcccatgagtcaatttccctaataagtcccctctcatctctctctgtatatatcctatttgttctgttcttgggagaaccctgactaataca

SEQ ID NO: 1545 - DNA, 5505 bp, synthetic construct
  misc_feature 1..5505: note = Synthetic polypeptide
  source 1..5505: mol_type = other DNA
atggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatccttagacactccggagggggccattatgggggacgtcaaggtggaagatggtgctgacgtgagcatctcggacctcttcaacaccagggttaacaagggcccgagggtgaccgtgcttttggggaaggctggcatgggcaagaccacgctggcccaccggctctgccagaagtgggcagagggccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctcccaatctgcaga

SEQ ID NO: 1546 - DNA, 5418 bp, synthetic construct
  misc_feature 1..5418: note = Synthetic polypeptide
  source 1..5418: mol_type = other DNA
atggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatccttagacactccggagggggccattatgggggacgtcaaggtggaagatggtgctgacgtgagcatctcggacctcttcaacaccagggttaacaagggcccgagggtgaccgtgcttttggggaaggctggcatgggcaagaccacgctggcccaccggctctgccagaagtgggcagagggccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggtctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctcccaatctgcaga

SEQ ID NO: 1547 - DNA, 2501 bp, synthetic construct; identical to SEQ ID NO: 1164
  misc_feature 1..2501: note = Synthetic polypeptide
  source 1..2501: mol_type = other DNA

SEQ ID NO: 1548 - DNA, 2552 bp, synthetic construct; identical to SEQ ID NO: 1165
  misc_feature 1..2552: note = Synthetic polypeptide
  source 1..2552: mol_type = other DNA

SEQ ID NO: 1549 - DNA, 2456 bp, synthetic construct; identical to SEQ ID NO: 1166
  misc_feature 1..2456: note = Synthetic polypeptide
  source 1..2456: mol_type = other DNA

SEQ ID NO: 1550 - DNA, 588 bp, synthetic construct; identical to SEQ ID NO: 1167
  misc_feature 1..588: note = Synthetic polypeptide
  source 1..588: mol_type = other DNA

SEQ ID NO: 1551 - DNA, 2161 bp, synthetic construct; identical to SEQ ID NO: 288
  misc_feature 1..2161: note = Synthetic polypeptide
  source 1..2161: mol_type = other DNA

SEQ ID NO: 1552 - DNA, 2140 bp, synthetic construct; identical to SEQ ID NO: 289
  misc_feature 1..2140: note = Synthetic polypeptide
  source 1..2140: mol_type = other DNA

SEQ ID NO: 1553 - DNA, 529 bp, synthetic construct; identical to SEQ ID NO: 287
  misc_feature 1..529: note = Synthetic polypeptide
  source 1..529: mol_type = other DNA

SEQ ID NO: 1554 - DNA, 1736 bp, synthetic construct; identical to SEQ ID NO: 156
  misc_feature 1..1736: note = Synthetic polypeptide
  source 1..1736: mol_type = other DNA

SEQ ID NO: 1555 - DNA, 1724 bp, synthetic construct; identical to SEQ ID NO: 157
  misc_feature 1..1724: note = Synthetic polypeptide
  source 1..1724: mol_type = other DNA

SEQ ID NO: 1556 - DNA, 1692 bp, synthetic construct; identical to SEQ ID NO: 1048
  misc_feature 1..1692: note = Synthetic polypeptide
  source 1..1692: mol_type = other DNA

SEQ ID NO: 1557 - DNA, 1695 bp, synthetic construct; identical to SEQ ID NO: 1049
  misc_feature 1..1695: note = Synthetic polypeptide
  source 1..1695: mol_type = other DNA

SEQ ID NO: 1558 - DNA, 466 bp, synthetic construct; identical to SEQ ID NO: 1050
  misc_feature 1..466: note = Synthetic polypeptide
  source 1..466: mol_type = other DNA

SEQ ID NO: 1559 - DNA, 103 bp, synthetic construct; identical to SEQ ID NO: 173
  misc_feature 1..103: note = Synthetic polypeptide
  source 1..103: mol_type = other DNA

SEQ ID NO: 1560 - DNA, 3881 bp, synthetic construct; identical to SEQ ID NO: 1162
  misc_feature 1..3881: note = Synthetic polypeptide
  source 1..3881: mol_type = other DNA

SEQ ID NO: 1561 - DNA, 3722 bp, synthetic construct; identical to SEQ ID NO: 1163
  misc_feature 1..3722: note = Synthetic polypeptide
  source 1..3722: mol_type = other DNA

SEQ ID NO: 1562 - DNA, 577 bp, synthetic construct; identical to SEQ ID NO: 1112
  misc_feature 1..577: note = Synthetic polypeptide
  source 1..577: mol_type = other DNA

SEQ ID NO: 1563 - DNA, 252 bp, synthetic construct; identical to SEQ ID NO: 1113
  misc_feature 1..252: note = Synthetic polypeptide
  source 1..252: mol_type = other DNA

SEQ ID NO: 1564 - DNA, 533 bp, synthetic construct; identical to SEQ ID NO: 1098
  misc_feature 1..533: note = Synthetic polypeptide
  source 1..533: mol_type = other DNA

SEQ ID NO: 1565 - DNA, 572 bp, synthetic construct; identical to SEQ ID NO: 159
  misc_feature 1..572: note = Synthetic polypeptide
  source 1..572: mol_type = other DNA

SEQ ID NO: 1566 - DNA, 1028 bp, synthetic construct
  misc_feature 1..1028: note = Synthetic polypeptide
  source 1..1028: mol_type = other DNA
atggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagaaacaaaaacgaaaacaaaaacaaa

SEQ ID NO: 1567 - DNA, 674 bp, synthetic construct
  misc_feature 1..674: note = Synthetic polypeptide
  source 1..674: mol_type = other DNA
atgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagaaacaaaaacgaaaacaaaaacaaa

SEQ ID NO: 1568 - DNA, 752 bp, synthetic construct
  misc_feature 1..752: note = Synthetic polypeptide
  source 1..752: mol_type = other DNA
atggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagagcagtctccccagcccaccatccccatcgtgggcatcgttgctggccttgttgtccttggagctgtggtcactggagctgtggtcgctgctgtgatgtggaggaagaagagctcagaaacaaaaacgaaaacaaaaacaaa

SEQ ID NO: 1569 - DNA, 664 bp, synthetic construct
  misc_feature 1..664: note = Synthetic polypeptide
  source 1..664: mol_type = other DNA
gcccagaccctccacccgggagagtcccaggcgcctttacccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagaaacaaaaacgaaaacaaaaacaaa

SEQ ID NO: 1570 - DNA, 55 bp, synthetic construct
  misc_feature 1..55: note = Synthetic polypeptide
  source 1..55: mol_type = other DNA
ctgctgtgatgtggaggaagaagagctcagaaacaaaaacgaaaacaaaaacaaa

SEQ ID NO: 1571 - DNA, 519 bp, synthetic construct
  misc_feature 1..519: note = Synthetic polypeptide
  source 1..519: mol_type = other DNA
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgg

SEQ ID NO: 1572 - DNA, 723 bp, synthetic construct
  misc_feature 1..723: note = Synthetic polypeptide
  source 1..723: mol_type = other DNA
atggcccttgtgatccaggtggggaaactaaggcccagagaagtgaggaccccgcagactatcaatcccagtctcttcccctcactccctgtgaagctctccagcatcatcgaggtcccatcaggtggggaaagatgctgttccaggcgcacactagtctacaaggccagagctttctggaagggggcacccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgg

SEQ ID NO: 1573 - DNA, 483 bp, synthetic construct
  misc_feature 1..483: note = Synthetic polypeptide
  source 1..483: mol_type = other DNA
atggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgg

SEQ ID NO: 1574 - DNA, 516 bp, synthetic construct
  misc_feature 1..516: note = Synthetic polypeptide
  source 1..516: mol_type = other DNA
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagatggctgaggacaaggcctctgtgaaagcccaggtgacgtccttgctcggggagctgcaggagagccagagtcgcttggaggctgccactaaggaatgccaggctctggagggtcgg

SEQ ID NO: 1575 - DNA, 117 bp, synthetic construct
  misc_feature 1..117: note = Synthetic polypeptide
  source 1..117: mol_type = other DNA
atggctgaggacaaggcctctgtgaaagcccaggtgacgtccttgctcggggagctgcaggagagccagagtcgcttggaggctgccactaaggaatgccaggctctggagggtcgg

SEQ ID NO: 1576 - DNA, 1097 bp, synthetic construct; identical to SEQ ID NO: 1040
  misc_feature 1..1097: note = Synthetic polypeptide
  source 1..1097: mol_type = other DNA

SEQ ID NO: 1577 - DNA, 965 bp, synthetic construct; identical to SEQ ID NO: 1041
  misc_feature 1..965: note = Synthetic polypeptide
  source 1..965: mol_type = other DNA

SEQ ID NO: 1578 - DNA, 258 bp, synthetic construct; identical to SEQ ID NO: 265
  misc_feature 1..258: note = Synthetic polypeptide
  source 1..258: mol_type = other DNA

SEQ ID NO: 1579 - DNA, 243 bp, synthetic construct; identical to SEQ ID NO: 267
  misc_feature 1..243: note = Synthetic polypeptide
  source 1..243: mol_type = other DNA

SEQ ID NO: 1580 - DNA, 324 bp, synthetic construct; identical to SEQ ID NO: 268
  misc_feature 1..324: note = Synthetic polypeptide
  source 1..324: mol_type = other DNA

SEQ ID NO: 1581 - DNA, 175 bp, synthetic construct
  misc_feature 1..175: note = Synthetic polypeptide
  source 1..175: mol_type = other DNA
atgaatctgccgccggatcgcccgggactgctttcactttctgtcaggtagctgccctccaggggcagagaagcccagccatggtcaggagagccacccagctgaggcccacctccaccaggattgccacccagctgaaccccacctcagccaggagagccacccagctgagccc

SEQ ID NO: 1582 - DNA, 1049 bp, synthetic construct; identical to SEQ ID NO: 224
  misc_feature 1..1049: note = Synthetic polypeptide
  source 1..1049: mol_type = other DNA

SEQ ID NO: 1583 - DNA, 639 bp, synthetic construct; identical to SEQ ID NO: 1196
  misc_feature 1..639: note = Synthetic polypeptide
  source 1..639: mol_type = other DNA

SEQ ID NO: 1584 - DNA, 500 bp, synthetic construct; identical to SEQ ID NO: 1197
  misc_feature 1..500: note = Synthetic polypeptide
  source 1..500: mol_type = other DNA

SEQ ID NO: 1585 - DNA, 1346 bp, synthetic construct; identical to SEQ ID NO: 1198
  misc_feature 1..1346: note = Synthetic polypeptide
  source 1..1346: mol_type = other DNA

SEQ ID NO: 1586 - DNA, 901 bp, synthetic construct; identical to SEQ ID NO: 1199
  misc_feature 1..901: note = Synthetic polypeptide
  source 1..901: mol_type = other DNA

SEQ ID NO: 1587 - DNA, 586 bp, synthetic construct; identical to SEQ ID NO: 401
  misc_feature 1..586: note = Synthetic polypeptide
  source 1..586: mol_type = other DNA

SEQ ID NO: 1588 - DNA, 829 bp, synthetic construct; identical to SEQ ID NO: 402
  misc_feature 1..829: note = Synthetic polypeptide
  source 1..829: mol_type = other DNA

SEQ ID NO: 1589 - DNA, 1060 bp, synthetic construct; identical to SEQ ID NO: 403
  misc_feature 1..1060: note = Synthetic polypeptide
  source 1..1060: mol_type = other DNA

SEQ ID NO: 1590 - DNA, 730 bp, synthetic construct; identical to SEQ ID NO: 406
  misc_feature 1..730: note = Synthetic polypeptide
  source 1..730: mol_type = other DNA

SEQ ID NO: 1591 - DNA, 496 bp, synthetic construct; identical to SEQ ID NO: 408
  misc_feature 1..496: note = Synthetic polypeptide
  source 1..496: mol_type = other DNA

SEQ ID NO: 1592 - DNA, 1470 bp, synthetic construct
  misc_feature 1..1470: note = Synthetic polypeptide
  source 1..1470: mol_type = other DNA
atggctgggccgcggggcgcgctgctggcctggtgccgccgccagtgcgagggctaccgcggcgtggagatccgcgacctgagcagctccttccgggacggcctggccttctgcgccatcctgcaccggcaccggcccgacctgctagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccagcccccctgcgggccgccccacccctgcccccaggaaggcctctgagagcaccaccccagcaccccccacgccccggccccgctccagtctgcagcaggagaacctggtggagcaggctggcagcagcagcctggtgaacgggagactgcacgaactgcctgtccccaagccgagggggacaccgaagccgtccgaggggacaccagcccccaggaaggaccccccatggatcacgctggtgcaggcagaaccaaagaagaagccagccccacttcccccaagcagcagcccggggccaccaagccaggacagcaggcaggtggagaatggaggcaccgaggaggtggcccagccgagcccaacggccagcctggagtccaaaccctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggataat

SEQ ID NO: 1593 - DNA, 202 bp, synthetic construct
  misc_feature 1..202: note = Synthetic polypeptide
  source 1..202: mol_type = other DNA
ctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggataat

SEQ ID NO: 1594 - DNA, 2451 bp, synthetic construct
  misc_feature 1..2451: note = Synthetic polypeptide
  source 1..2451: mol_type = other DNA
atggctgtgaggcaggcggcgacggcgggcactcccgggcccaggagagaggaagaggcggcgcttctattcgagagggcccattaccggcacgacccgcgctggctgctgcccgtgaccccccgcctgtgcctggcctgcgcgctggagctgctgccggaccccggcgtgtcgttagtgcgcaagaagcacatgttgtcctgcttccaagatgcccttgtgaggcatacctccctggtcacgcaactggtgtctcaggatcagagagtctgcatccacttcataagtgtgctttttggactattatgcagcatggaagatgggagtgtgacagacctctgtattgaagtccttattcagatcacaacgcagctgaagctggagcagactatccgttgcctgctggatgagtgccacaaagagctgtgtaacatgccctccatgcgaggcagcctggccaccctgacccttcttggcaagttggtggatgccatccctgctctggcagacgagcttgtaatggagcatggcaacctgatggagcatctgttgagaggcttagtataccccagtgagggcatacaagcttctgtctgttacctttatgggaagctatactcctcaccagtggcagctgagatgctttcaggacacttccgtgagaagctttttcccctcttcctttccatcctggatggtgcccagacaaaggagctgcagattaactgcttgggtttgctgaggcagctgttgaagtatgatctctttgtgtccatgatcatgaaccaggatggactgggagaaagtgctaagaatatcgaagggtcatcaggaaatacctcactgcctttggtgctcaaaaagcttctcctctctagagatgaaaccctgcaggtggccagtgctcactgtataactgcggtgcttgtccactccccagcaaagcatgcgtcagccttcatccacgctgacatcccagagttcctctttgagcatctttcttcttccagtgaagtgctcgtctggtccagctgtaactgcttgacactcctggtagaagagccactctttttttccaagtgccacacggtgtatgggatcgaggcagtggtgaggagcctgcagggaagcctgaagatgaacaacatagagctgcacaagcagggcctgctgcttttcgctgaaatcctgacccggcagccagaggagatcaagctgttcacaagctcagccatgtgcagagatgctggccgtgccctccaagaagcagttagcagccctgtgctggaggtggctgctgaggccttgaaggccacttctgcttttctgaggaaggaccatcagagcactccacctgtgcagtatggggaactgcaggctttgctagaagccatgctaaaccgatgtgcggagttttcccagaccttgctgagcaggaggcccctgggccatgcctccagtagagattcagagaaggccattcttcaaaggggaaagttcctcctcagcactctggagggatttagaagtgcctgcaggttggctatagaattccagagtgagccttcagcccaggagaatccattcacagctcccagcgccaagaaggaagacaccttggaggccttctcagaatttcttctcagtgcctgtgactcgctgtgtatccccatggtgatgagacacttggagcagaccacccacccagctttgatggaagttttcctctcaattctacataacctctttgtcatcgttccccacatgaaggagaagttttccaagaagcttgcttcctcatccttcatacgactgaccctggagctgaaggccaggttttgcagtggtctgagtcactcagccctaaaccaggtgtgttccaatttcctctactatatgtgcctcaaccttctctcagctccagagaagacaggaccaccttccaaagaagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggccgggcgcggtggcttactcctgtaatcccagctctttgggaggccgagatgggcagatcacgaggtcaggagatcgagaccatcatggctaacaaggtaaaaccccgtctctactaaaaatacaaaaaaattagctgggcatggtggtgggtgcctgtagtcccagctactcgggaggctgaggcaggagaatggtgtgaacccgggaggcagagctctcagtgagccgagatcgtgccactgcactccagcctgggcgacagagcgagactccgtctcaaaaaataaataaataaataaataaataaataaaaataaaaatacaaaaa

SEQ ID NO: 1595 - DNA, 1671 bp, synthetic construct
  misc_feature 1..1671: note = Synthetic polypeptide
  source 1..1671: mol_type = other DNA
atgaaccaggatggactgggagaaagtgctaagaatatcgaagggtcatcaggaaatacctcactgcctttggtgctcaaaaagcttctcctctctagagatgaaaccctgcaggtggccagtgctcactgtataactgcggtgcttgtccactccccagcaaagcatgcgtcagccttcatccacgctgacatcccagagttcctctttgagcatctttcttcttccagtgaagtgctcgtctggtccagctgtaactgcttgacactcctggtagaagagccactctttttttccaagtgccacacggtgtatgggatcgaggcagtggtgaggagcctgcagggaagcctgaagatgaacaacatagagctgcacaagcagggcctgctgcttttcgctgaaatcctgacccggcagccagaggagatcaagctgttcacaagctcagccatgtgcagagatgctggccgtgccctccaagaagcagttagcagccctgtgctggaggtggctgctgaggccttgaaggccacttctgcttttctgaggaaggaccatcagagcactccacctgtgcagtatggggaactgcaggctttgctagaagccatgctaaaccgatgtgcggagttttcccagaccttgctgagcaggaggcccctgggccatgcctccagtagagattcagagaaggccattcttcaaaggggaaagttcctcctcagcactctggagggatttagaagtgcctgcaggttggctatagaattccagagtgagccttcagcccaggagaatccattcacagctcccagcgccaagaaggaagacaccttggaggccttctcagaatttcttctcagtgcctgtgactcgctgtgtatccccatggtgatgagacacttggagcagaccacccacccagctttgatggaagttttcctctcaattctacataacctctttgtcatcgttccccacatgaaggagaagttttccaagaagcttgcttcctcatccttcatacgactgaccctggagctgaaggccaggttttgcagtggtctgagtcactcagccctaaaccaggtgtgttccaatttcctctactatatgtgcctcaaccttctctcagctccagagaagacaggaccaccttccaaagaagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggccgggcgcggtggcttactcctgtaatcccagctctttgggaggccgagatgggcagatcacgaggtcaggagatcgagaccatcatggctaacaaggtaaaaccccgtctctactaaaaatacaaaaaaattagctgggcatggtggtgggtgcctgtagtcccagctactcgggaggctgaggcaggagaatggtgtgaacccgggaggcagagctctcagtgagccgagatcgtgccactgcactccagcctgggcgacagagcgagactccgtctcaaaaaataaataaataaataaataaataaataaaaataaaaatacaaaaa

SEQ ID NO: 1596 - DNA, 555 bp, synthetic construct
  misc_feature 1..555: note = Synthetic polypeptide
  source 1..555: mol_type = other DNA
atgtgcctcaaccttctctcagctccagagaagacaggaccaccttccaaagaagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggccgggcgcggtggcttactcctgtaatcccagctctttgggaggccgagatgggcagatcacgaggtcaggagatcgagaccatcatggctaacaaggtaaaaccccgtctctactaaaaatacaaaaaaattagctgggcatggtggtgggtgcctgtagtcccagctactcgggaggctgaggcaggagaatggtgtgaacccgggaggcagagctctcagtgagccgagatcgtgccactgcactccagcctgggcgacagagcgagactccgtctcaaaaaataaataaataaataaataaataaataaaaataaaaatacaaaaa

SEQ ID NO: 1597 - DNA, 405 bp, synthetic construct
  misc_feature 1..405: note = Synthetic polypeptide
  source 1..405: mol_type = other DNA
atggagggagctgctcgccagagacagtactgcatcctgctcctcttctacttggcctacatccatgaagacaggccgggcgcggtggcttactcctgtaatcccagctctttgggaggccgagatgggcagatcacgaggtcaggagatcgagaccatcatggctaacaaggtaaaaccccgtctctactaaaaatacaaaaaaattagctgggcatggtggtgggtgcctgtagtcccagctactcgggaggctgaggcaggagaatggtgtgaacccgggaggcagagctctcagtgagccgagatcgtgccactgcactccagcctgggcgacagagcgagactccgtctcaaaaaataaataaataaataaataaataaataaaaataaaaatacaaaaa

SEQ ID NO: 1598 - DNA, 722 bp, synthetic construct
  misc_feature 1..722: note = Synthetic polypeptide
  source 1..722: mol_type = other DNA
atgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaagggtgggccaggaggcagattctcatcagatttggaagg

SEQ ID NO: 1599 - DNA, 866 bp, synthetic construct
  misc_feature 1..866: note = Synthetic polypeptide
  source 1..866: mol_type = other DNA
atgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaagggtgggccaggaggcagattctcatcagatttggaagg

SEQ ID NO: 1600 - DNA, 740 bp, synthetic construct
  misc_feature 1..740: note = Synthetic polypeptide
  source 1..740: mol_type = other DNA
atgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaagggtgggccaggaggcagattctcatcagatttggaagg

SEQ ID NO: 1601 - DNA, 492 bp, synthetic construct
  misc_feature 1..492: note = Synthetic polypeptide
  source 1..492: mol_type = other DNA
atgaggcaaaatgacaaaatcatgtgcatattggaaaaccggaaaaagagggataggaaaaatctctgtagggctatcaatgacttccaacagagctttcagaagccagaaactcgccgtgaatttgatctgtccgaccccctagcccttaagaaagatcttccagcccggcagtcagataatgatgttcggaatacgatatcaggaatgcagaaattcatgggagaggatttaaacttccatgagaggaagaaattccaagaggaacaaaacagagaatggtctttgcagcagcaaagggaatggaagaacgcccgtgctgaacaaaaatgcgcagacctgaccttctacccacatccgtgacagctcctttcttctagctgcccaggccccagcccaggtaatcttgactccttcctttctctccatttttcagctactttccacaccctccaacattcccattctgaactaaggctatcagcatctctc

SEQ ID NO: 1602 - DNA, 696 bp, synthetic construct
  misc_feature 1..696: note = Synthetic polypeptide
  source 1..696: mol_type = other DNA
atggcggtggcgctgcccagggacttgcggcaggacgccaacctggcaaagaggaggcacgcggagctgtgcaggcagaagcgggtcttcaacgccagaaacaggataattgggggagacactgaagcctgggatgttcaagttcatgaccagaagataaaagaagctactgaaaaagctagacatgaaactttggctgctgaaatgaggcaaaatgacaaaatcatgtgcatattggaaaaccggaaaaagagggataggaaaaatctctgtagggctatcaatgacttccaacagagctttcagaagccagaaactcgccgtgaatttgatctgtccgaccccctagcccttaagaaagatcttccagcccggcagtcagataatgatgttcggaatacgatatcaggaatgcagaaattcatgggagaggatttaaacttccatgagaggaagaaattccaagaggaacaaaacagagaatggtctttgcagcagcaaagggaatggaagaacgcccgtgctgaacaaaaatgcgcagacctgaccttctacccacatccgtgacagctcctttcttctagctgcccaggccccagcccaggtaatcttgactccttcctttctctccatttttcagctactttccacaccctccaacattcccattctgaactaaggctatcagcatctctc

SEQ ID NO: 1603 - DNA, 712 bp, synthetic construct; identical to SEQ ID NO: 1187
  misc_feature 1..712: note = Synthetic polypeptide
  source 1..712: mol_type = other DNA

SEQ ID NO: 1604 - DNA, 523 bp, synthetic construct
  misc_feature 1..523: note = Synthetic polypeptide
  source 1..523: mol_type = other DNA
atgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1605 - DNA, 661 bp, synthetic construct
  misc_feature 1..661: note = Synthetic polypeptide
  source 1..661: mol_type = other DNA
atgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1606 - DNA, 493 bp, synthetic construct
  misc_feature 1..493: note = Synthetic polypeptide
  source 1..493: mol_type = other DNA
atgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1607 - DNA, 463 bp, synthetic construct
  misc_feature 1..463: note = Synthetic polypeptide
  source 1..463: mol_type = other DNA
atgtgcttcccgaaggtcctctctgatgacatgaagaagctgaaggcccgaatggtgatgtcgagcctggcagagctggaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1608 - DNA, 436 bp, synthetic construct
  misc_feature 1..436: note = Synthetic polypeptide
  source 1..436: mol_type = other DNA
atgtgcttcccgaaggtcctctctgatgacatgaagaagctgaaggcccgaatggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1609 - DNA, 496 bp, synthetic construct
  misc_feature 1..496: note = Synthetic polypeptide
  source 1..496: mol_type = other DNA
atgtgcttcccgaaggtcctctctgatgacatgaagaagctgaaggcccgaatgcaccaggccatagaaagattttatgataaaatgcaaaatgcagaatcaggacgtggacaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1610 - DNA, 595 bp, synthetic construct
  misc_feature 1..595: note = Synthetic polypeptide
  source 1..595: mol_type = other DNA
atgtgcttcccgaaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1611 - DNA, 634 bp, synthetic construct
  misc_feature 1..634: note = Synthetic polypeptide
  source 1..634: mol_type = other DNA
atgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1612 - DNA, 1747 bp, synthetic construct
  misc_feature 1..1747: note = Synthetic polypeptide
  source 1..1747: mol_type = other DNA
atggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagatttctggttaccatcagctgggaaaagagaacgaaatcagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagcagcattattcacagtcgtcaaggtggaaacaaatcacatgtccattgctggatgaatggatgaacacaatttgccgtatatatacaatggaatattatgtagcttgaaagcctttcttattcagaatgaaactctgccatgtgctacaaattggatgaagacatttgctaagtcaaataagttagacacaaaaggagaaatattgtgtgattccacttttataagctactagaatagtcaacttcatacaaacagaaaggaacatagtggttgccaggggctaggggaagagggaaatggggggagttattgtttaatgggtacagagtttccatttgagatgatgaaaaagtcctggtgataaatagtggtgacagttatacaacagtgtgaatgtacttaatgcgactgaactgtacagttaaaaatggataagatagcaaattttatgtatattttactataataaaaaa

SEQ ID NO: 1613 - DNA, 1762 bp, synthetic construct
  misc_feature 1..1762: note = Synthetic polypeptide
  source 1..1762: mol_type = other DNA
atggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagaaaagaataaagcgttggcttctgattttcctcacatttctgcttgtgcacatgagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagcagcattattcacagtcgtcaaggtggaaacaaatcacatgtccattgctggatgaatggatgaacacaatttgccgtatatatacaatggaatattatgtagcttgaaagcctttcttattcagaatgaaactctgccatgtgctacaaattggatgaagacatttgctaagtcaaataagttagacacaaaaggagaaatattgtgtgattccacttttataagctactagaatagtcaacttcatacaaacagaaaggaacatagtggttgccaggggctaggggaagagggaaatggggggagttattgtttaatgggtacagagtttccatttgagatgatgaaaaagtcctggtgataaatagtggtgacagttatacaacagtgtgaatgtacttaatgcgactgaactgtacagttaaaaatggataagatagcaaattttatgtatattttactataataaaaaa

SEQ ID NO: 1614 - DNA, 624 bp, synthetic construct
  misc_feature 1..624: note = Synthetic polypeptide
  source 1..624: mol_type = other DNA
atgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagcagcattattcacagtcgtcaaggtggaaacaaatcacatgtccattgctggatgaatggatgaacacaatttgccgtatatatacaatggaatattatgtagcttgaaagcctttcttattcagaatgaaactctgccatgtgctacaaattggatgaagacatttgctaagtcaaataagttagacacaaaaggagaaatattgtgtgattccacttttataagctactagaatagtcaacttcatacaaacagaaaggaacatagtggttgccaggggctaggggaagagggaaatggggggagttattgtttaatgggtacagagtttccatttgagatgatgaaaaagtcctggtgataaatagtggtgacagttatacaacagtgtgaatgtacttaatgcgactgaactgtacagttaaaaatggataagatagcaaattttatgtatattttactataataaaaaa

SEQ ID NO: 1615 - DNA, 965 bp, synthetic construct
  misc_feature 1..965: note = Synthetic polypeptide
  source 1..965: mol_type = other DNA
atgaggccacgatgctgcatcttggctcttgtctgctggataacagtcttcctcctccagtgttcaaaaggaactacagacgctcctgttggctcaggactgtggctgtgccagccgacacccaggtgtgggaacaagatctacaacccttcagagcagtgctgttatgatgatgccatcttatccttaaaggagacccgccgctgtggctccacctgcaccttctggccctgctttgagctctgctgtcccgagtcttttggcccccagcagaagtttcttgtgaagttgagggttctgggtatgaagtctcagtgtcacttatctcccatctcccggagctgtaccaggctccactggcagacggcagacaaggggagaagagacgaagcagctggacatcggagactacagttgaacttcggagagaagcaacttgacttcagagggatggctcaatgacatagctttggagaggagcccagctggggatggccagacttcaggggaagaatgccttcctgcttcatcccctttccagctccccttcccgctgagagccactttcatcggcaataaaatcccccacatttaccatcttcaattcgttcatgcaacctgattcttcctggacactgagcaggagctcaggatacagagggctgtcacaccgagctgttcaacacctaagccattcatggatggcagagccaaaagagcactgactgtaacactccctctgaggcttcatgagttgtgggcatcccccagatgctgctgcagggccagtacacagttgtgctcctgccagtgcccaaaacacacctacccgggctcctgcatccccttgccggcaagctgcacccccaccccaccccacccactggtgagcaattgagcactacaggctgagcgagtgaggcacctctgtcacaagtcttgtgaaggggttagggaaattatcc

SEQ ID NO: 1616 - DNA, 3378 bp, synthetic construct; identical to SEQ ID NO: 1228
  misc_feature 1..3378: note = Synthetic polypeptide
  source 1..3378: mol_type = other DNA

SEQ ID NO: 1617 - DNA, 952 bp, synthetic construct
  misc_feature 1..952: note = Synthetic polypeptide
  source 1..952: mol_type = other DNA
atgaggccacgatgctgcatcttggctcttgtctgctggataacagtcttcctcctccagtgttcaaaaggaactacagacgctcctgttggctcaggactgtggctgtgccagccgacacccaggtgtgggaacaagatctacaacccttcagagcagtgctgttatgatgatgccatcttatccttaaaggagacccgccgctgtggctccacctgcaccttctggccctgctttgagctctgctgtcccgagtcttttggcccccagcagaagtttcttgtgaagttgagggttctgggtatgaagtctcagtgtcacttatctcccatctcccggagctgtaccagacggcagacaaggggagaagagacgaagcagctggacatcggagactacagttgaacttcggagagaagcaacttgacttcagagggatggctcaatgacatagctttggagaggagcccagctggggatggccagacttcaggggaagaatgccttcctgcttcatcccctttccagctccccttcccgctgagagccactttcatcggcaataaaatcccccacatttaccatcttcaattcgttcatgcaacctgattcttcctggacactgagcaggagctcaggatacagagggctgtcacaccgagctgttcaacacctaagccattcatggatggcagagccaaaagagcactgactgtaacactccctctgaggcttcatgagttgtgggcatcccccagatgctgctgcagggccagtacacagttgtgctcctgccagtgcccaaaacacacctacccgggctcctgcatccccttgccggcaagctgcacccccaccccaccccacccactggtgagcaattgagcactacaggctgagcgagtgaggcacctctgtcacaagtcttgtgaaggggttagggaaattatcc

SEQ ID NO: 1618 - DNA, 459 bp, synthetic construct; identical to SEQ ID NO: 237
  misc_feature 1..459: note = Synthetic polypeptide
  source 1..459: mol_type = other DNA

SEQ ID NO: 1619 - DNA, 2849 bp, synthetic construct; identical to SEQ ID NO: 1326
  misc_feature 1..2849: note = Synthetic polypeptide
  source 1..2849: mol_type = other DNA

SEQ ID NO: 1620 - DNA, 1925 bp, synthetic construct; identical to SEQ ID NO: 1327
  misc_feature 1..1925: note = Synthetic polypeptide
  source 1..1925: mol_type = other DNA

SEQ ID NO: 1621 - DNA, 2729 bp, synthetic construct; identical to SEQ ID NO: 1328
  misc_feature 1..2729: note = Synthetic polypeptide
  source 1..2729: mol_type = other DNA

SEQ ID NO: 1622 - DNA, 2549 bp, synthetic construct; identical to SEQ ID NO: 1329
  misc_feature 1..2549: note = Synthetic polypeptide
  source 1..2549: mol_type = other DNA

SEQ ID NO: 1623 - DNA, 285 bp, synthetic construct
  misc_feature 1..285: note = Synthetic polypeptide
  source 1..285: mol_type = other DNA
atgtccgcccagaggttaatttctaacagaacctcccagcaatcggcatctaattctgattacacctgggaatatgaatattatgagattggaccagtttcctttgaaggactgaaggctcataaatattccattgtgattggattttgggttggtcttgcagtcttcgtgatttttatgttttttgtgctgaccttgctgaccaagacaggagccccacaccaagatggcctgtcccaacaggaactcacatgggttgagaaaaaaaatttttccttcctgaca

SEQ ID NO: 1624 - DNA, 55 bp, synthetic construct; identical to SEQ ID NO: 291
  misc_feature 1..55: note = Synthetic polypeptide
  source 1..55: mol_type = other DNA

SEQ ID NO: 1625 - DNA, 25 bp, synthetic construct
  misc_feature 1..25: note = Synthetic polypeptide
  source 1..25: mol_type = other DNA
atgagcgtcctttcgtttttttaaa

SEQ ID NO: 1626 - DNA, 1426 bp, synthetic construct
  misc_feature 1..1426: note = Synthetic polypeptide
  source 1..1426: mol_type = other DNA
atggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggtgggccctaaatccaatgactggtgtccttatgagaagaggagaggccacagagggacacatggagaaggccatggacggcagaggcaggggtcaaggtgacacagccacagccgagggacgcctagagtcacccgaagcggggaggggcaggaaggatcctccttggagccttcggaaggagcggggccctgcccacaccttggtttcagccttctggacatcagaacttcgagggaatccttttctgttacttcgagccaccaggtttgtgtaattcgctactacggcagtcacaggaa

SEQ ID NO: 1627 - DNA, 1108 bp, synthetic construct
  misc_feature 1..1108: note = Synthetic polypeptide
  source 1..1108: mol_type = other DNA
atgccttttgctcccgttgcccaggctagagtgcaatggcacgatttccgttcactgcaacatctgcttcccgcgttcaagcgattctcctgcctcagccttgggagtagttgggattacagtgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaaatgattaaacagcactttttgcagaaatggaaaaacctgtccttaaattcatatgaagctacaggagaccctaaatagccaaacaatcttgaaaaaggacaaagttggaagactcatatttcctgatttcaaaacatactacaaagctacagtcatcaaaacagtatggcactggcgttaacagtagccatagagaccaatggaatagaattgggggtccaaaacaaatgcatacatctatggccagttggtttttgacaaggaggccaagtttatttaatggagaaagaatagtctcttcaataaatgttgctgggaaacaggatttccttacaaaaaagaatgaagttggattcctacctcacagcatatgtaaaaattaaatcaaaatggatcagtgacctaaatataagggctaaaaccatttataactatcttagaggaaaacataatgataaatcttcatgaccttgaatttgttgatagattcttatataacaacaccaaaagcacaatgaacaaaagaaaaaataaatttgactttatcaaaagtaaaagcttttgtgtttcaaagtacaccatcaagaaagtgaaaaggcaaagcacagaatgggagaaaatattttcaaattatatatctaataagggtttaaggtccagagtagatcaagagcttccaaaactcaacaagaaaaaagacaatccaattttaaatataggcaaagacttgagtaga

SEQ ID NO: 1628 - DNA, 991 bp, synthetic construct
  misc_feature 1..991: note = Synthetic polypeptide
  source 1..991: mol_type = other DNA
atgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaaatgattaaacagcactttttgcagaaatggaaaaacctgtccttaaattcatatgaagctacaggagaccctaaatagccaaacaatcttgaaaaaggacaaagttggaagactcatatttcctgatttcaaaacatactacaaagctacagtcatcaaaacagtatggcactggcgttaacagtagccatagagaccaatggaatagaattgggggtccaaaacaaatgcatacatctatggccagttggtttttgacaaggaggccaagtttatttaatggagaaagaatagtctcttcaataaatgttgctgggaaacaggatttccttacaaaaaagaatgaagttggattcctacctcacagcatatgtaaaaattaaatcaaaatggatcagtgacctaaatataagggctaaaaccatttataactatcttagaggaaaacataatgataaatcttcatgaccttgaatttgttgatagattcttatataacaacaccaaaagcacaatgaacaaaagaaaaaataaatttgactttatcaaaagtaaaagcttttgtgtttcaaagtacaccatcaagaaagtgaaaaggcaaagcacagaatgggagaaaatattttcaaattatatatctaataagggtttaaggtccagagtagatcaagagcttccaaaactcaacaagaaaaaagacaatccaattttaaatataggcaaagacttgagtaga

SEQ ID NO: 1629 - DNA, 3934 bp, synthetic construct; identical to SEQ ID NO: 1150
  misc_feature 1..3934: note = Synthetic polypeptide
  source 1..3934: mol_type = other DNA

SEQ ID NO: 1630 - DNA, 3787 bp, synthetic construct; identical to SEQ ID NO: 1151
  misc_feature 1..3787: note = Synthetic polypeptide
  source 1..3787: mol_type = other DNA

SEQ ID NO: 1631 - DNA, 867 bp, synthetic construct; identical to SEQ ID NO: 1152
  misc_feature 1..867: note = Synthetic polypeptide
  source 1..867: mol_type = other DNA

SEQ ID NO: 1632 - DNA, 996 bp, synthetic construct; identical to SEQ ID NO: 1153
  misc_feature 1..996: note = Synthetic polypeptide
  source 1..996: mol_type = other DNA

SEQ ID NO: 1633 - DNA, 510 bp, synthetic construct
  misc_feature 1..510: note = Synthetic polypeptide
  source 1..510: mol_type = other DNA
atgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacgggcttcatctgtgaaatgaatgggagtaacagcaacatccacctcacaggttcaggtaagagtaaataacacaaggtacataaagcactcagcacagttcctaccacata

SEQ ID NO: 1634 - DNA, 1977 bp, synthetic construct
  misc_feature 1..1977: note = Synthetic polypeptide
  source 1..1977: mol_type = other DNA
atggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctgcctgccttgcctcccagatatcaggctcctgagggcagggcccatgcctgatttatgtcagtggcaagccctggagaacatcagtgaatgtttgttgagtgagtgagt

SEQ ID NO: 1635 - DNA, 2076 bp, synthetic construct
  misc_feature 1..2076: note = Synthetic polypeptide
  source 1..2076: mol_type = other DNA
atgagcggccggaagcgcagcttcaccttcggggcctacggcggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctgcctgccttgcctcccagatatcaggctcctgagggcagggcccatgcctgatttatgtcagtggcaagccctggagaacatcagtgaatgtttgttgagtgagtgagt

SEQ ID NO: 1636 - DNA, 2139 bp, synthetic construct
  misc_feature 1..2139: note = Synthetic polypeptide
  source 1..2139: mol_type = other DNA
atgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctgtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctgcctgccttgcctcccagatatcaggctcctgagggcagggcccatgcctgatttatgtcagtggcaagccctggagaacatcagtgaatgtttgttgagtgagtgagt

SEQ ID NO: 1637 - DNA, 1884 bp, synthetic construct
  misc_feature 1..1884: note = Synthetic polypeptide
  source 1..1884: mol_type = other DNA
atgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctgcctgccttgcctcccagatatcaggctcctgagggcagggcccatgcctgatttatgtcagtggcaagccctggagaacatcagtgaatgtttgttgagtgagtgagt

SEQ ID NO: 1638 - DNA, 1962 bp, synthetic construct
  misc_feature 1..1962: note = Synthetic polypeptide
  source 1..1962: mol_type = other DNA
atgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctgcctgccttgcctcccagatatcaggctcctgagggcagggcccatgcctgatttatgtcagtggcaagccctggagaacatcagtgaatgtttgttgagtgagtgagt

SEQ ID NO: 1639 - DNA, 1379 bp, synthetic construct; identical to SEQ ID NO: 985
  misc_feature 1..1379: note = Synthetic polypeptide
  source 1..1379: mol_type = other DNA

SEQ ID NO: 1640 - DNA, 846 bp, synthetic construct
  misc_feature 1..846: note = Synthetic polypeptide
  source 1..846: mol_type = other DNA
atgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactggccaggtgcagtggctcacacctgtatatcccaacactttgggaggccaagatgggtggatcacctgaggtcggaagttcaagaccagcctgatcaacatggagaaaccctgtctctactaaaaatacaaaattagccaggcatggtggcacatgcctgtaatcccagctacctgggaggctgagacagaagaattgcttgaacccgggaagcagaggttgcggtgagtcaagatcacgccattgcactccagcctgggcaacaagaacaaaactccatctaaaaaaaa

SEQ ID NO: 1641 - DNA, 714 bp, synthetic construct
  misc_feature 1..714: note = Synthetic polypeptide
  source 1..714: mol_type = other DNA
atgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaagactacaaaggcatttcttcctgcaatgacgaagaataaccatggccatattgtcactgtggcttcggcagctggacatgtctcggtccccttcttactggcttactggccaggtgcagtggctcacacctgtatatcccaacactttgggaggccaagatgggtggatcacctgaggtcggaagttcaagaccagcctgatcaacatggagaaaccctgtctctactaaaaatacaaaattagccaggcatggtggcacatgcctgtaatcccagctacctgggaggctgagacagaagaattgcttgaacccgggaagcagaggttgcggtgagtcaagatcacgccattgcactccagcctgggcaacaagaacaaaactccatctaaaaaaaa

SEQ ID NO: 1642 - DNA, 681 bp, synthetic construct
  misc_feature 1..681: note = Synthetic polypeptide
  source 1..681: mol_type = other DNA
atgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccggaggccagctccaccagggcaagggtttttccctgcctgccactgtatgccgagtgtccagaacaaagcctagcacaaggtgggtatcccagaaatatttgtgggatga

SEQ ID NO: 1643 - DNA, 534 bp, synthetic construct
  misc_feature 1..534: note = Synthetic polypeptide
  source 1..534: mol_type = other DNA
atgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccggaggccagctccaccagggcaagggtttttccctgcctgccactgtatgccgagtgtccagaacaaagcctagcacaaggtgggtatcccagaaatatttgtgggatga

SEQ ID NO: 1644 - DNA, 270 bp, synthetic construct
  misc_feature 1..270: note = Synthetic polypeptide
  source 1..270: mol_type = other DNA
aagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccggaggccagctccaccagggcaagggtttttccctgcctgccactgtatgccgagtgtccagaacaaagcctagcacaaggtgggtatcccagaaatatttgtgggatga

SEQ ID NO: 1645 - DNA, 596 bp, synthetic construct
  misc_feature 1..596: note = Synthetic polypeptide
  source 1..596: mol_type = other DNA
caaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccggaggccagctccaccagggcaagggtttttccctgcctgccactgtatgccgagtgtccagaacaaagcctagcacaaggtgggtatcccagaaatatttgtgggatga

SEQ ID NO: 1646 - DNA, 1261 bp, synthetic construct
  misc_feature 1..1261: note = Synthetic polypeptide
  source 1..1261: mol_type = other DNA
atggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcatcgactggaccaagatcgagcccagcgtcaacttcctcaagtcgcccaaaggcaacttcagagccacctaaggagtttcacgggccacatgggcagtgagtgccctatgaacagctctctattgaccaacaagagccgcctggtttatggatgacaggcggctttcaaggtgacaggacagcttcctatctggaagaccatcaaagaaggtaaaaacaaatcacctcagcaggttgaattgactggtgtttgtgctacatctcacgggcagtggccaacctgcccgcacagtcagcagaagggcaatggaaaactggcctattagtgatcccactaataggtccacatgggcctgtggacatcattatgggagtcggaggggtacattaaagtaggacgtttgatgttcatcagaagaaccccattccaggatcagggggtgattggattcagtcagtggatattctggtgtgctcacttaaggaggcctcatgatatgagggacatacggggttgccacagtgcagggatggactgagtctagacatgttccccttgcaccctctgaggcacaaaacaccagtaactgttctgtctgtcaacgagaggcttgataggcaagtcacactgaagcctgtagccccaggaagtgtaagtcgtggcaggaacagtcactctgcacactgggctcagcttccctgtggtagatgcaaatgctcacagcacagtaaaaggactggaactca

SEQ ID NO: 1647 - DNA, 1605 bp, synthetic construct
  misc_feature 1..1605: note = Synthetic polypeptide
  source 1..1605: mol_type = other DNA
atggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaaggcaacttcagagccacctaaggagtttcacgggccacatgggcagtgagtgccctatgaacagctctctattgaccaacaagagccgcctggtttatggatgacaggcggctttcaaggtgacaggacagcttcctatctggaagaccatcaaagaaggtaaaaacaaatcacctcagcaggttgaattgactggtgtttgtgctacatctcacgggcagtggccaacctgcccgcacagtcagcagaagggcaatggaaaactggcctattagtgatcccactaataggtccacatgggcctgtggacatcattatgggagtcggaggggtacattaaagtaggacgtttgatgttcatcagaagaaccccattccaggatcagggggtgattggattcagtcagtggatattctggtgtgctcacttaaggaggcctcatgatatgagggacatacggggttgccacagtgcagggatggactgagtctagacatgttccccttgcaccctctgaggcacaaaacaccagtaactgttctgtctgtcaacgagaggcttgataggcaagtcacactgaagcctgtagccccaggaagtgtaagtcgtggcaggaacagtcactctgcacactgggctcagcttccctgtggtagatgcaaatgctcacagcacagtaaaaggactggaactca

SEQ ID NO: 1648 - DNA, 518 bp, synthetic construct
  misc_feature 1..518: note = Synthetic polypeptide
  source 1..518: mol_type = other DNA
atggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgagtgagtccaagctgttttctgatagttgc

SEQ ID NO: 1649 - DNA, 3992 bp, synthetic construct; identical to SEQ ID NO: 120
  misc_feature 1..3992: note = Synthetic polypeptide
  source 1..3992: mol_type = other DNA

SEQ ID NO: 1650 - DNA, 3845 bp, synthetic construct; identical to SEQ ID NO: 121
  misc_feature 1..3845: note = Synthetic polypeptide
  source 1..3845: mol_type = other DNA

SEQ ID NO: 1651 - DNA, 500 bp, synthetic construct; identical to SEQ ID NO: 204
  misc_feature 1..500: note = Synthetic polypeptide
  source 1..500: mol_type = other DNA

SEQ ID NO: 1652 - DNA, 656 bp, synthetic construct; identical to SEQ ID NO: 205
  misc_feature 1..656: note = Synthetic polypeptide
  source 1..656: mol_type = other DNA

SEQ ID NO: 1653 - DNA, 524 bp, synthetic construct; identical to SEQ ID NO: 207
  misc_feature 1..524: note = Synthetic polypeptide
  source 1..524: mol_type = other DNA

SEQ ID NO: 1654 - DNA, 1747 bp, synthetic construct
  misc_feature 1..1747: note = Synthetic polypeptide
  source 1..1747: mol_type = other DNA
atggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgccacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagggctgttaggaggctcagatga

SEQ ID NO: 1655 - DNA, 1081 bp, synthetic construct; identical to SEQ ID NO: 986
  misc_feature 1..1081: note = Synthetic polypeptide
  source 1..1081: mol_type = other DNA

SEQ ID NO: 1656 - DNA, 1054 bp, synthetic construct; identical to SEQ ID NO: 987
  misc_feature 1..1054: note = Synthetic polypeptide
  source 1..1054: mol_type = other DNA

SEQ ID NO: 1657 - DNA, 235 bp, synthetic construct
  misc_feature 1..235: note = Synthetic polypeptide
  source 1..235: mol_type = other DNA
atgagtgccaacaccttcggcaatgccggcttttccgttctcctgcctggggcccggctcgagggccgctgtgggcccaccaatgcccgggtcagatgccatctggcagctactcaggaggctgagacacgagaatcacttgaacctgggaagcagagtgagctgagatcacaccactccactccagcctgggtgagagagtgagactttgtctcaaaaaaaaaaaaaaaaaaaa

SEQ ID NO: 1658 - DNA, 1078 bp, synthetic construct
  misc_feature 1..1078: note = Synthetic polypeptide
  source 1..1078: mol_type = other DNA
atgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctggcagctactcaggaggctgagacacgagaatcacttgaacctgggaagcagagtgagctgagatcacaccactccactccagcctgggtgagagagtgagactttgtctcaaaaaaaaaaaaaaaaaaaa

SEQ ID NO: 1659 - DNA, 413 bp, synthetic construct
  misc_feature 1..413: note = Synthetic polypeptide
  source 1..413: mol_type = other DNA
atggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtggtttctaagcttatggatatgcaagggcatacagagtggtataatgtacattggagactcagaaggctggcaagcaggagagaggtgagagatgaaaaagtacctattggatatagtgttcaggtggtgggtgcactaaaattctagacttctccatggtaccgttcatccatgtaaccaaaaaatcactcatacccctaaagctactgaaataaaaaaa

SEQ ID NO: 1660 - DNA, 1825 bp, synthetic construct
  misc_feature 1..1825: note = Synthetic polypeptide
  source 1..1825: mol_type = other DNA
atgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctgatgtctgcggaaacatccctcgtcagaagcgcttgctcagttgtacacatgagcccgagggtcctcagcttttctttccataggttccagaggccgtagtttctttgtaagactctaggtgtttatgtgattattggcttaatgtctatttccttcccaggccccataaggggagggctgagtctgtcccgtttatcattaaatcctcagctcaagcccctagcctggcacgcagtaggtgctcaacagaatgaagggaggaatgaat

SEQ ID NO: 1661 - DNA, 1825 bp, synthetic construct
  misc_feature 1..1825: note = Synthetic polypeptide
  source 1..1825: mol_type = other DNA
atgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctgatgtctgcggaaacatccctcgtcagaagcgcttgctcagttgtacacatgagcccgagggtcctcagcttttctttccataggttccagaggccgtagtttctttgtaagactctaggtgtttatgtgattattggcttaatgtctatttccttcccaggccccataaggggagggctgagtctgtcccgtttatcattaaatcctcagctcaagcccctagcctggcacgcagtaggtgctcaacagaatgaagggaggaatgaat

SEQ ID NO: 1662 - DNA, 935 bp, synthetic construct
  misc_feature 1..935: note = Synthetic polypeptide
  source 1..935: mol_type = other DNA
atgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggccaaagtgcccgccttgcagggtccttggcagatgagatgacctaacgtggcaaagtggttagaccagcg

SEQ ID NO: 1663 - DNA, 641 bp, synthetic construct
  misc_feature 1..641: note = Synthetic polypeptide
  source 1..641: mol_type = other DNA
atgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggccaaagtgcccgccttgcagggtccttggcagatgagatgacctaacgtggcaaagtggttagaccagcg

SEQ ID NO: 1664 - DNA, 2362 bp, synthetic construct
  misc_feature 1..2362: note = Synthetic polypeptide
  source 1..2362: mol_type = other DNA
atggatgatgtcctgcccctgatgccttgggagaccctgttggcacagggcagtccccagggctcgcctgacctcccagcagggcagcggaagcagcagccacagggtgacagggcccagggcctggcctctgagtcctggaagctcctggaggtgcccatcattcacataacgccatccagtgatggggagtcccccgcctgcaccccaaccccccgacgccggcagcagcagaggatgccagacccgcagagtctgtcccaggacagcaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagcattgcaggggaaagcatggaagcatggatg

SEQ ID NO: 1665 - DNA, 2113 bp, synthetic construct
  misc_feature 1..2113: note = Synthetic polypeptide
  source 1..2113: mol_type = other DNA
atgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtgatctgtgtgagccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagcattgcaggggaaagcatggaagcatggatg

SEQ ID NO: 1666 - DNA, 1399 bp, synthetic construct
  misc_feature 1..1399: note = Synthetic polypeptide
  source 1..1399: mol_type = other DNA
atgcactgcttgaaaaggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagcattgcaggggaaagcatggaagcatggatg

SEQ ID NO: 1667 - DNA, 2080 bp, synthetic construct
  misc_feature 1..2080: note = Synthetic polypeptide
  source 1..2080: mol_type = other DNA
atgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagcattgcaggggaaagcatggaagcatggatg

SEQ ID NO: 1668 - DNA, 1221 bp, synthetic construct; identical to SEQ ID NO: 122
  misc_feature 1..1221: note = Synthetic polypeptide
  source 1..1221: mol_type = other DNA

SEQ ID NO: 1669 - DNA, 193 bp, synthetic construct; identical to SEQ ID NO: 975
  misc_feature 1..193: note = Synthetic polypeptide
  source 1..193: mol_type = other DNA

SEQ ID NO: 1670 - DNA, 3961 bp, synthetic construct
  misc_feature 1..3961: note = Synthetic polypeptide
  source 1..3961: mol_type = other DNA
atggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggtcctggctctgtccagcggctccagaaaggccagtgcggtgggtgatgtggtcaatctggtgtccgtggacgtgcagcggctgaccgagagcgtcctctacctcaacgggctgtggctgcctctcgtctggatcgtggtctgcttcgtctatctctggcagctcctggggccctccgccctcactgccatcgctgtcttcctgagcctcctccctctgaatttcttcatctccaagaaaaggaaccaccatcaggaggagcaaatgaggcagaaggactcacgggcacggctcaccagctctatcctcaggaactcgaagaccatcaagttccatggctgggagggagcctttctggacagagtcctgggcatccgaggccaggagctgggcgccttgcggacctccggcctcctcttctctgtgtcgctggtgtccttccaagtgtctacatttctggtcgcactggtggtgtttgctgtccacactctggtggccgagaatgctatgaatgcagagaaagcctttgtgactctcacagttctcaacatcctcaacaaggcccaggctttcctgcccttctccatccactccctcgtccaggcccgggtgtcctttgaccgtctggtcaccttcctctgcctggaagaagttgaccctggtgtcgtagactcaagttcctctggaagcgctgccgggaaggattgcatcaccatacacagtgccaccttcgcctggtcccaggaaagccctccctgcctccacagaataaacctcacggtgccccagggctgtctgctggctgttgtcggtccagtgggggcagggaagtcctccctgctgtccgccctccttggggagctgtcaaaggtggaggggttcgtgagcatcgagggtgctgtggcctacgtgccccaggaggcctgggtgcagaacacctctgtggtagagaatgtgtgcttcgggcaggagctggacccaccctggctggagagagtactagaagcctgtgccctgcagccagatgtggacagcttccctgagggaatccacacttcaattggggagcagggcatgaatctctccggaggccagaagcagcggctgagcctggcccgggctgtatacagaaaggcagctgtgtacctgctggatgaccccctggcggccctggatgcccacgttggccagcatgtcttcaaccaggtcattgggcctggtggactactccagggaacaacacggattctcgtgacgcacgcactccacatcctgccccaggctgattggatcatagtgctggcaaatggggccatcgcagagatgggttcctaccaggagcttctgcagaggaagggggccctcatgtgtcttctggatcaagccagacagccaggagatagaggagaaggagaaacagaacctgggaccagcaccaaggaccccagaggcacctctgcaggcaggaggcccgagcttagacgcgagaggtccatcaagtcagtccctgagaaggaccgtaccacttcagaagcccagacagaggttcctctggatgaccctgacagggcaggatggccagcaggaaaggacagcatccaatacggcagggtgaaggccacagtgcacctggcctacctgcgtgccgtgggcacccccctctgcctctacgcactcttcctcttcctctgccagcaagtggcctccttctgccggggctactggctgagcctgtgggcggacgaccctgcagtaggtgggcagcagacgcaggcagccctgcgtggcgggatcttcgggctcctcggctgtctccaagccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcctctacgctgggtttcagagcctgtatgtggttagctcatgccagctgagacgcttggagtcagccagctactcgtctgtctgctcccacatggctgagacgttccagggcagcacagtggtccgggcattccgaacccaggccccctttgtggctcagaacaatgctcgcgtagatgaaagccagaggatcagtttcccgcgactggtggctgacaggtggcttgcggccaatgtggagctcctggggaatggcctggtgtttgcagctgccacgtgtgctgtgctgagcaaagcccacctcagtgctggcctcgtgggcttctctgtctctgctgccctccaggtgacccagacactgcagtgggttgttcgcaactggacagacctagagaacagcatcgtgtcagtggagcggatgcaggactatgcctggacgcccaaggaggctccctggaggctgcccacatgtgcagctcagcccccctggcctcagggcgggcagatcgagttccgggactttgggctaagataccgacctgagctcccgctggctgtgcagggcgtgtccttcaagatccacgcaggagagaagaccggatgatgggcacactggagcaaggactctttaatttctatacttccggtgcctaaacaggtacttggcatacagt

SEQ ID NO: 1671 - DNA, 37 bp, synthetic construct
  misc_feature 1..37: note = Synthetic polypeptide
  source 1..37: mol_type = other DNA
atggtggcccgggtgtggtcgctgatgaggtgggaat

SEQ ID NO: 1672 - DNA, 369 bp, synthetic construct
  misc_feature 1..369: note = Synthetic polypeptide
  source 1..369: mol_type = other DNA
gcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggctgaggcaggagcatcacttgaagctcggagtttgagaccagcctgggcaacatagcaagaccccacccatttctacaaagaaacaagaa

SEQ ID NO: 1673 - DNA, 410 bp, synthetic construct
  misc_feature 1..410: note = Synthetic polypeptide
  source 1..410: mol_type = other DNA
atggcggcgcagggcgtagggcctgggccggggtcggcggcgcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggctgaggcaggagcatcacttgaagctcggagtttgagaccagcctgggcaacatagcaagaccccacccatttctacaaagaaacaagaa

SEQ ID NO: 1674 - DNA, 514 bp, synthetic construct
  misc_feature 1..514: note = Synthetic polypeptide
  source 1..514: mol_type = other DNA
atggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgagtgagtccaagctgttttctgatagttgc

SEQ ID NO: 1675 - DNA, 8540 bp, synthetic construct
  misc_feature 1..8540: note = Synthetic polypeptide
  source 1..8540: mol_type = other DNA
atgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagggaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggagccagagggacctttctaaaacgcacatctggctacttccctccactccacaaatccttcgggacgccctgtggcctgcaggacaaagccccacctctgcgggagtggcgtgtgaggctcttcaccaacgggccttgcccgccctgtgttctcctcctgcccgcccccacacatgccctgtgctccagccacacccagcgccttgcagtctaaggagagcccatgcctttggacatgctgttccttctgcctggaatttccttgtccgcctggtgaactcctcgttctgcaagactccgctcaaaacagcaccttcgagaagactgccctgccccttccctgccttgccccatgtccccctcccttgggtccccagagccacgcacatccagccctgcttcccacacacggggccgtgcgtgcctttcttcaccactgagctccttcaagggcagggactgtctttatctttgcatcccccgctgcaccctgtgcctgcccactgggcactcggtggatg

SEQ ID NO: 1676 - DNA, 734 bp, synthetic construct; identical to SEQ ID NO: 930
  misc_feature 1..734: note = Synthetic polypeptide
  source 1..734: mol_type = other DNA

SEQ ID NO: 1677 - DNA, 1490 bp, synthetic construct
  misc_feature 1..1490: note = Synthetic polypeptide
  source 1..1490: mol_type = other DNA
atggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaagaaagtttgttgacc

SEQ ID NO: 1678 - DNA, 1451 bp, synthetic construct
  misc_feature 1..1451: note = Synthetic polypeptide
  source 1..1451: mol_type = other DNA
atgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaacacaacaccatctggcagcagatttcagcgggagcagccatggaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaagaaagtttgttgacc

SEQ ID NO: 1679 - DNA, 926 bp, synthetic construct
  misc_feature 1..926: note = Synthetic polypeptide
  source 1..926: mol_type = other DNA
atgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaagaaagtttgttgacc

SEQ ID NO: 1680 - DNA, 1451 bp, synthetic construct
  misc_feature 1..1451: note = Synthetic polypeptide
  source 1..1451: mol_type = other DNA
atggcttctccgtggcgcggagcccatgaagtcctggagggtatttgggagccaaaaagaaaaagaagaaacagaagagaaaaaaggagaaaccaaattccggaggcaccaagtcagactcggcatctgattcccaggagattaaaattcagcagccttcgaaacacaacaccatctggcagcagatttcagcgggagcagccatggaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaagaaagtttgttgacc

SEQ ID NO: 1681 - DNA, 314 bp, synthetic construct; identical to SEQ ID NO: 998
  misc_feature 1..314: note = Synthetic polypeptide
  source 1..314: mol_type = other DNA

SEQ ID NO: 1682 - DNA, 2466 bp, synthetic construct
  misc_feature 1..2466: note = Synthetic polypeptide
  source 1..2466: mol_type = other DNA
atgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaaggccgggtacggtggcctggaatcccaacacttcggaaggctgaggcaggagaattgcttgagcccaggagttcaagaccagcctgggcaacatagcaagaccccatctctacaaaacaaacaaaaa

SEQ ID NO: 1683 - DNA, 1806 bp, synthetic construct
  misc_feature 1..1806: note = Synthetic polypeptide
  source 1..1806: mol_type = other DNA
atgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaaggccgggtacggtggcctggaatcccaacacttcggaaggctgaggcaggagaattgcttgagcccaggagttcaagaccagcctgggcaacatagcaagaccccatctctacaaaacaaacaaaaa

SEQ ID NO: 1684 - DNA, 2412 bp, synthetic construct
  misc_feature 1..2412: note = Synthetic polypeptide
  source 1..2412: mol_type = other DNA
atgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaaggccgggtacggtggcctggaatcccaacacttcggaaggctgaggcaggagaattgcttgagcccaggagttcaagaccagcctgggcaacatagcaagaccccatctctacaaaacaaacaaaaa

SEQ ID NO: 1685 - DNA, 2211 bp, synthetic construct
  misc_feature 1..2211: note = Synthetic polypeptide
  source 1..2211: mol_type = other DNA
atgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaaggccgggtacggtggcctggaatcccaacacttcggaaggctgaggcaggagaattgcttgagcccaggagttcaagaccagcctgggcaacatagcaagaccccatctctacaaaacaaacaaaaa

SEQ ID NO: 1686 - DNA, 364 bp, synthetic construct
  misc_feature 1..364: note = Synthetic polypeptide
  source 1..364: mol_type = other DNA
ttgcagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaaggccgggtacggtggcctggaatcccaacacttcggaaggctgaggcaggagaattgcttgagcccaggagttcaagaccagcctgggcaacatagcaagaccccatctctacaaaacaaacaaaaa

SEQ ID NO: 1687 - DNA, 5110 bp, synthetic construct
  misc_feature 1..5110: note = Synthetic polypeptide
  source 1..5110: mol_type = other DNA
atgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtgagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgctgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggtttcttgtctctctggctccaccagaagaggagcagggacccttcttgctgttgttcattgctgcatcccccacaccgagagcagagcctggcatgggcagaaagtcctcagtcgatatttggtggccccaagcgaatgaa

SEQ ID NO: 1688 - DNA, 436 bp, synthetic construct
  misc_feature 1..436: note = Synthetic polypeptide
  source 1..436: mol_type = other DNA
aacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagacgaagagaaccagaaacaatgccaggacctcggcgccttcaccgagagcatggtttcttgtctctctggctccaccagaagaggagcagggacccttcttgctgttgttcattgctgcatcccccacaccgagagcagagcctggcatgggcagaaagtcctcagtcgatatttggtggccccaagcgaatgaa

SEQ ID NO: 1689 - DNA, 133 bp, synthetic construct
  misc_feature 1..133: note = Synthetic polypeptide
  source 1..133: mol_type = other DNA
atggccggcttcaacatggggggcgacctcagggagcctgccgccagcattcccccgggctccctggcagctgttggcatctcgaagaagcttctctgcccttcattgggtaggtgtgaagaggcaaagagat

SEQ ID NO: 1690 - DNA, 874 bp, synthetic construct
  misc_feature 1..874: note = Synthetic polypeptide
  source 1..874: mol_type = other DNA
atgacccagatgtcccaggtgcaggagctcttccatgaggcagcccagcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccccgggctccctggcagctgttggcatctcgaagaagcttctctgcccttcattgggtaggtgtgaagaggcaaagagat

SEQ ID NO: 1691 - DNA, 961 bp, synthetic construct
  misc_feature 1..961: note = Synthetic polypeptide
  source 1..961: mol_type = other DNA
atgctgcctttagaacgaactatcacttacagagacatgtcttcattcatacaggtgaaaaaccatttcaatgtagtcaatgtgacatgcgtttcatacagaagtacctgcttcagagacatgagaagattcatactggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccccgggctccctggcagctgttggcatctcgaagaagcttctctgcccttcattgggtaggtgtgaagaggcaaagagat

SEQ ID NO: 1692 - DNA, 520 bp, synthetic construct
  misc_feature 1..520: note = Synthetic polypeptide
  source 1..520: mol_type = other DNA
ctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccccgggctccctggcagctgttggcatctcgaagaagcttctctgcccttcattgggtaggtgtgaagaggcaaagagat

SEQ ID NO: 1693 - DNA, 277 bp, synthetic construct
  misc_feature 1..277: note = Synthetic polypeptide
  source 1..277: mol_type = other DNA
atgcgcagagctgcagctggagggcttgcggtgggacagcttccaggagagggtcccgcaggagaggaaggggcagccctggggaaggcgatgcgtggaggaggctgctcaccccattccccatctgggtgtctttcaggagtcatggccggcttcaacatggggggcgacctcagggagcctgccgccagcattcccccgggctccctggcagctgttggcatctcgaagaagcttctctgcccttcattgggtaggtgtgaagaggcaaagagat

SEQ ID NO: 1694 - DNA, 1731 bp, synthetic construct; identical to SEQ ID NO: 989
  misc_feature 1..1731: note = Synthetic polypeptide
  source 1..1731: mol_type = other DNA

SEQ ID NO: 1695 - DNA, 2262 bp, synthetic construct; identical to SEQ ID NO: 990
  misc_feature 1..2262: note = Synthetic polypeptide
  source 1..2262: mol_type = other DNA

SEQ ID NO: 1696 - DNA, 2253 bp, synthetic construct; identical to SEQ ID NO: 991
  misc_feature 1..2253: note = Synthetic polypeptide
  source 1..2253: mol_type = other DNA

SEQ ID NO: 1697 - DNA, 3992 bp, synthetic construct; identical to SEQ ID NO: 120
  misc_feature 1..3992: note = Synthetic polypeptide
  source 1..3992: mol_type = other DNA

SEQ ID NO: 1698 - DNA, 3845 bp, synthetic construct; identical to SEQ ID NO: 121
  misc_feature 1..3845: note = Synthetic polypeptide
  source 1..3845: mol_type = other DNA

SEQ ID NO: 1699 - DNA, 1598 bp, synthetic construct
  misc_feature 1..1598: note = Synthetic polypeptide
  source 1..1598: mol_type = other DNA
atgcagggcgaagagagcctccggatcctggtggagcccgaaggggacagcttcccgctgatggagatcagcacctgtgagaccgaggcctccgagcagtgggactatgtcctcgtggcccaacgtcacacccagagagacccccggcaggcgcggcagcaacagttcctggaggagctcaggagaaagggcttccacattaaggtgatccgggaccagaaacaggtcttctttgggatccgtgctgacaacagtgtctttggcctgtaccgcactttcctcctggagcctgaggggcctgccccccacgccgagctggccgcgccgaccaccatcccggtcaccacgagtctcagaatccgaatcgtgaacttcgttgtcatgaacaacaagacctcggctggtgagaccttcgaggatctgatgaaggacggggtctttgaggccaggttccccctgcacaagggggagggacgcctgaagaagacgtgggcgcggtggagacacatgttccgggagcagccagttgatgaaatcaggaactactttggggaaaaggtggccctgtacttcgtctggctgggctggtacacctacatgctggtgccggccgccctgacgggcctcttagtctttctgagcggattctcgctgtttgaggccagccagatcagcaaggagatctgtgaggcccacgacatcctcatgtgtcccctcggcgaccacagccgcaggtaccagcggctctcggaaacctgcacttttgccaagctcacccacctctttgacaatgatggcacggtggtgttcgccatcttcatggctctctgggccacggtgttcctggagatctggaagcggcagcgcgcccgcgtggtcctgcactgggacctgtacgtgtgggacgaggaacaggaggaaatggcacttcagctcattaactgccccgactacaagctccggccataccagcactcctacctacgcagcaccgtcatcctcgtcctgaccctgctcatgatctgcctcatgatcggcatggcccacgtcctggtggtctaccgcgtcctggcctccgcgctcttcagcagctcggccgtgcccttcctggaggagcaggtgaccacggccgtggtggtgaccggggctctggtgcactatgtgaccatcatcatcatgaccaagatcaacaggtgcgtggccctgaagctttgtgacttcgagatgcccaggaccttctcggagcgagagagcaggttcaccatccgcttcttcacactgcagttcttcacccatttctcgtctctcatctacatcgccttcatcctgggcaggtgcagtggcttatgcctgaaatcccagcactttgggaggctgaggcaggcagatcacctgaggtcaggagttcaagaccagactggccaacatgaagaaaccccgtctctactagccaggcgtggtggtgtgagcctgtagtcccagctactcgggaggctgaggcacaagaatcacttgaacccaggaggcagaggttgcagtgaactgaaatcgcaccattgcgctccagcctgggtgacagagtgaggctccatctcaaa

SEQ ID NO: 1700 - DNA, 640 bp, synthetic construct
  misc_feature 1..640: note = Synthetic polypeptide
  source 1..640: mol_type = other DNA
atggctgcccgtggtgtcatcgctccagttggcgagagtttgcgctacgctgagtacttgcagccctcggccaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggcctcaagaagcattgcagcttcagctcttaccttcttagatccttgagtccaccaagtgaagaagactaagctctcctcctgacggaagaaacaccaagtagagagaggcctagctatcccagcttaggccctagtgaggccatcctggactacccagctcagaataaccaccctaccaatccacagaaaagtgagaaataaaaagaacattgttgcttttcgccactaagttttggggtggtttgttatgcagaaa

SEQ ID NO: 1701 - DNA, 559 bp, synthetic construct
  misc_feature 1..559: note = Synthetic polypeptide
  source 1..559: mol_type = other DNA
atggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgccaggagccgtggctcacacctgtaaacccagcactttgggaagccgaggcaggaggattgcttgagcccaggagttcaagaccagcctaggcaacatggcaagaccccatctctacaaaagtaacaaaa

SEQ ID NO: 1702 - DNA, 225 bp, synthetic construct
  misc_feature 1..225: note = Synthetic polypeptide
  source 1..225: mol_type = other DNA
atggcaggcctgatgaccatagtaaccagccttctgttccttggtgtctgtgcccaccacatcatccctacgggctctgtggtcatcccctctccctgctgcatgttctttgtttccaagagaattcctgagaaccgagtggtcagctaccagctgtccagcaggagcacatgcctcaaggcaggagtgatcctggacaacagagtgagaccctgtgtcaaaaaa

SEQ ID NO: 1703 - DNA, 1168 bp, synthetic construct
  misc_feature 1..1168: note = Synthetic polypeptide
  source 1..1168: mol_type = other DNA
atgtcagacaacaaagaaaggaagagtcaaggatttcctaaagaagataaccaagacacaagttcattagctgatgctgtagagaaagttgcaaagcaacaacaatcacaagcatcagagatagaaaaaaacaaaaaggttctgttcaatttgaagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggaagacattacaaacttaaaggataaaattataactgtaaaagaatctatcattgaaaaaacttgttttcttgaggaagaaaaaaagacacatgaaaaattaagaaaagaaatagagaccttgcaccacccatccactggagtcatccttgctgaccacaagatatctcttgaaacggagataagcagcatcccactgtaaatcttactcaagggagttaaccttattgcaggcatgtgcacaagaccagaagaatgactgatctttaccctatccctcattataatactgaaattctcacccagggaagagcttatccatcatattttgatcatgcaatgtatgcgctagcatgatttctcattgtgcctgcacaccctgtgctccacccggcacatgtaatgacacttccatacctcatgcacattcctgtcacctttcctagaaacaccacaaagacctgccctcagaaagccagccagctaactcttgctcctgcactgtctccattgtgttcaaacataagcccccaataaaagccttgtttgggaaacttgctcagccttgtgtcaatttctattaaatgagagcctaagaacctgtggttggtaac

SEQ ID NO: 1704 - DNA, 412 bp, synthetic construct
  misc_feature 1..412: note = Synthetic polypeptide
  source 1..412: mol_type = other DNA
atgaggacgctgctgaccatcttgactgtgggatccctggctgctcacgcccctgaggacccctcggatctgctccagcacgtgaaattccagtccagcaactttgaaaacatcctgacgtgggacagcgggccggagggcaccccagacacggtctacagcatcgagtataagacgtacggagagagggactgggtggcaaagaagggctgtcagcggatcacccggaagtcctgcaacctgacggtggagacgggcaacctcacggagctctactatgccagggtcaccgctgtcagtgcgggaggccggtcagccaccaagatgactgacaggttcagctctctgcagcacagaagaagacccacagcattcatcacattctcaaaggagtctgtaaaccagcaaaggt

SEQ ID NO: 1705 - DNA, 725 bp, synthetic construct
  misc_feature 1..725: note = Synthetic polypeptide
  source 1..725: mol_type = other DNA
atgtgtaaaatggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggcaccatgaactgcacccataaaagacagtgaatttaatccgtaaatattgtgtgtgttctggctgctccaccaactggccattaccaccccctgccaccgccgccccgttccctgagacacaacaatattgaaattaggccacttaatagccctccattggcctccaagtg

SEQ ID NO: 1706 - DNA, 815 bp, synthetic construct
  misc_feature 1..815: note = Synthetic polypeptide
  source 1..815: mol_type = other DNA
atggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggcaccatgaactgcacccataaaagacagtgaatttaatccgtaaatattgtgtgtgttctggctgctccaccaactggccattaccaccccctgccaccgccgccccgttccctgagacacaacaatattgaaattaggccacttaatagccctccattggcctccaagtg

SEQ ID NO: 1707 - DNA, 2466 bp, synthetic construct; identical to SEQ ID NO: 1682
  misc_feature 1..2466: note = Synthetic polypeptide
  source 1..2466: mol_type = other DNA

SEQ ID NO: 1708 - DNA, 1806 bp, synthetic construct; identical to SEQ ID NO: 1683
  misc_feature 1..1806: note = Synthetic polypeptide
  source 1..1806: mol_type = other DNA

SEQ ID NO: 1709 - DNA, 2412 bp, synthetic construct; identical to SEQ ID NO: 1684
  misc_feature 1..2412: note = Synthetic polypeptide
  source 1..2412: mol_type = other DNA

SEQ ID NO: 1710 - DNA, 2211 bp, synthetic construct; identical to SEQ ID NO: 1685
  misc_feature 1..2211: note = Synthetic polypeptide
  source 1..2211: mol_type = other DNA

SEQ ID NO: 1711 - DNA, 364 bp, synthetic construct; identical to SEQ ID NO: 1686
  misc_feature 1..364: note = Synthetic polypeptide
  source 1..364: mol_type = other DNA

SEQ ID NO: 1712 - DNA, 4024 bp, synthetic construct
  misc_feature 1..4024: note = Synthetic polypeptide
  source 1..4024: mol_type = other DNA
atggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagctaaacaagcactggcctcaagagaagcaatattaaaacaatttgcagctcaccaccagccgctgactaacggcgcccccctgttccaacagccataactacagctttgattggacaagaggctgatttcagttaacttcctcctgatgagaaaaccacagccatggactgattctggccggtttacagaggctgtgtacttggttgcctttgtgtcctaaaaaggaggtgtagggcctaattgtaatacatgtaaatgttaattctccaccccaaagcacacatggttatatgttacctgcatgtttgttcagtacacatgcctcaggaccaccttcatgagtatttgaagctcttcgtataacctgttgactatgtatgtttggccaacctgttcaactaaaatttctgtctaattcctctctccctcaaagtgcctatttctggtctttgctggaagctacacttcccagctggtaggatggccacttggcaggctgtaaacttttacaagaaataaagtctccttttcgaaatgtatagatcttgtgatttttcagttaac

SEQ ID NO: 1713 - DNA, 4060 bp, synthetic construct
  misc_feature 1..4060: note = Synthetic polypeptide
  source 1..4060: mol_type = other DNA
atggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaaggcttcagatgaccttgaacatgaaaacaacaaaaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagctaaacaagcactggcctcaagagaagcaatattaaaacaatttgcagctcaccaccagccgctgactaacggcgcccccctgttccaacagccataactacagctttgattggacaagaggctgatttcagttaacttcctcctgatgagaaaaccacagccatggactgattctggccggtttacagaggctgtgtacttggttgcctttgtgtcctaaaaaggaggtgtagggcctaattgtaatacatgtaaatgttaattctccaccccaaagcacacatggttatatgttacctgcatgtttgttcagtacacatgcctcaggaccaccttcatgagtatttgaagctcttcgtataacctgttgactatgtatgtttggccaacctgttcaactaaaatttctgtctaattcctctctccctcaaagtgcctatttctggtctttgctggaagctacacttcccagctggtaggatggccacttggcaggctgtaaacttttacaagaaataaagtctccttttcgaaatgtatagatcttgtgatttttcagttaac

SEQ ID NO: 1714 - DNA, 314 bp, synthetic construct; identical to SEQ ID NO: 998
  misc_feature 1..314: note = Synthetic polypeptide
  source 1..314: mol_type = other DNA

SEQ ID NO: 1715 - DNA, 980 bp, synthetic construct; identical to SEQ ID NO: 139
  misc_feature 1..980: note = Synthetic polypeptide
  source 1..980: mol_type = other DNA

SEQ ID NO: 1716 - DNA, 1256 bp, synthetic construct; identical to SEQ ID NO: 140
  misc_feature 1..1256: note = Synthetic polypeptide
  source 1..1256: mol_type = other DNA

SEQ ID NO: 1717 - DNA, 1277 bp, synthetic construct; identical to SEQ ID NO: 142
  misc_feature 1..1277: note = Synthetic polypeptide
  source 1..1277: mol_type = other DNA

SEQ ID NO: 1718 - DNA, 1081 bp, synthetic construct; identical to SEQ ID NO: 986
  misc_feature 1..1081: note = Synthetic polypeptide
  source 1..1081: mol_type = other DNA

SEQ ID NO: 1719 - DNA, 1054 bp, synthetic construct; identical to SEQ ID NO: 987
  misc_feature 1..1054: note = Synthetic polypeptide
  source 1..1054: mol_type = other DNA

SEQ ID NO: 1720 - DNA, 500 bp, synthetic construct; identical to SEQ ID NO: 204
  misc_feature 1..500: note = Synthetic polypeptide
  source 1..500: mol_type = other DNA

SEQ ID NO: 1721 - DNA, 656 bp, synthetic construct; identical to SEQ ID NO: 205
  misc_feature 1..656: note = Synthetic polypeptide
  source 1..656: mol_type = other DNA

SEQ ID NO: 1722 - DNA, 524 bp, synthetic construct; identical to SEQ ID NO: 207
  misc_feature 1..524: note = Synthetic polypeptide
  source 1..524: mol_type = other DNA

SEQ ID NO: 1723 - DNA, 442 bp, synthetic construct
  misc_feature 1..442: note = Synthetic polypeptide
  source 1..442: mol_type = other DNA
atgaagatgagattcttcagttctccatgtggaaaagcagctgtggacccagtgagataccactacacacccgccaaaatggcgaaacgaaaatgaacaccaccaaacggtggcaaggaggcagcgcacctggaactcccgcacatcgctgatgggagcacaaaatggaacagcactgaagagaggcctggccactcctcaaacacacacctgcccccaaagccagcatatctcctattcgtccaagtgaaacaaaagaacatatcccttaaagtataattaaaaatatatatatatccacacaaacactgtcacagaaacgttcagagcagttttattcacaatcaccaaaagctggaaacagcccaggcatccatcaatggaaaaactgctacatccatccatgggaacctacttgatagtttaaagaaatggcctactt

SEQ ID NO: 1724 - DNA, 117 bp, synthetic construct; identical to SEQ ID NO: 928
  misc_feature 1..117: note = Synthetic polypeptide
  source 1..117: mol_type = other DNA

SEQ ID NO: 1725 - DNA, 51 bp, synthetic construct; identical to SEQ ID NO: 929
  misc_feature 1..51: note = Synthetic polypeptide
  source 1..51: mol_type = other DNA

SEQ ID NO: 1726 - DNA, 1721 bp, synthetic construct
  misc_feature 1..1721: note = Synthetic polypeptide
  source 1..1721: mol_type = other DNA
atggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagtttcctcatctgcaaagtgaagacgataacacctatttcatggggtcactgtgaagagtggatggtttgtgacatgtcaagagcttagcgtggtgcctggtacatggtaa

SEQ ID NO: 1727 - DNA, 520 bp, synthetic construct
  misc_feature 1..520: note = Synthetic polypeptide
  source 1..520: mol_type = other DNA
atggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggatctcctcccaaacgaacctcagacatccaggtttctgccttagatctgctttgggg

SEQ ID NO: 1728 - DNA, 312 bp, synthetic construct
  misc_feature 1..312: note = Synthetic polypeptide
  source 1..312: mol_type = other DNA
atggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggaaacaattgctatcaaagatggaagagaaaagatgaaccaaaatggttgttttctgaaaaattagagcatatttcttcatggagatgaagagtgtttccatatgccttttatgcaaata

SEQ ID NO: 1729 - DNA, 679 bp, synthetic construct
  misc_feature 1..679: note = Synthetic polypeptide
  source 1..679: mol_type = other DNA
atgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtctcttgccctgtgcagcttcctgcagactggacttgcaaagtccagcctgtatggctggagttcccatgcctgccaatctcctgtcgactgcgagtcagctccgatacttcaccagattcaggttgaaagagaccatggcatctgtcttggatgcatactctctctcgctggctctggggtagccagatgccatgctgtgtgctgccctgtgaagaggcatggccagtaaggaactgagggcaggaaccagggaagatttggggtcctcaggccagctgcccattgggaatgaaactctaccaacagccacctgggggagctggaagtgaatctcatcttagctgagccttctgatgagactgcagccccagctgacacctggattgcagactcatgaaagacc

SEQ ID NO: 1730 - DNA, 1181 bp, synthetic construct
  misc_feature 1..1181: note = Synthetic polypeptide
  source 1..1181: mol_type = other DNA
atgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagattctttcacaggactggtcaacatcttgacagatattaattggcgattcactggagacttcacggcacctgacctggtttgccgagtggtccgctatttgcaggttgtgctgctctacgcctctacctacgtcctggtgtccctcagcatagacagataccatgccatcgtctaccccatgaagttccttcaaggagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcaggatcatagatggaaatgactagccttgtctcagatgacacttcgaactttggacttttgagttaatgttggaataagttaagactttcggggactgttgggaaggcaggattgtattttgaaatttgagaaggacataaaatttgggagggggcag

SEQ ID NO: 1731 - DNA, 983 bp, synthetic construct
  misc_feature 1..983: note = Synthetic polypeptide
  source 1..983: mol_type = other DNA
atgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcaggatcatagatggaaatgactagccttgtctcagatgacacttcgaactttggacttttgagttaatgttggaataagttaagactttcggggactgttgggaaggcaggattgtattttgaaatttgagaaggacataaaatttgggagggggcag

SEQ ID NO: 1732 - DNA, 1148 bp, synthetic construct
  misc_feature 1..1148: note = Synthetic polypeptide
  source 1..1148: mol_type = other DNA
atgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagatattaattggcgattcactggagacttcacggcacctgacctggtttgccgagtggtccgctatttgcaggttgtgctgctctacgcctctacctacgtcctggtgtccctcagcatagacagataccatgccatcgtctaccccatgaagttccttcaaggagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcaggatcatagatggaaatgactagccttgtctcagatgacacttcgaactttggacttttgagttaatgttggaataagttaagactttcggggactgttgggaaggcaggattgtattttgaaatttgagaaggacataaaatttgggagggggcag

SEQ ID NO: 1733 - DNA, 609 bp, synthetic construct; identical to SEQ ID NO: 249
  misc_feature 1..609: note = Synthetic polypeptide
  source 1..609: mol_type = other DNA

SEQ ID NO: 1734 - DNA, 738 bp, synthetic construct; identical to SEQ ID NO: 250
  misc_feature 1..738: note = Synthetic polypeptide
  source 1..738: mol_type = other DNA

SEQ ID NO: 1735 - DNA, 537 bp, synthetic construct; identical to SEQ ID NO: 251
  misc_feature 1..537: note = Synthetic polypeptide
  source 1..537: mol_type = other DNA

SEQ ID NO: 1736 - DNA, 684 bp, synthetic construct; identical to SEQ ID NO: 253
  misc_feature 1..684: note = Synthetic polypeptide
  source 1..684: mol_type = other DNA

SEQ ID NO: 1737 - DNA, 285 bp, synthetic construct; identical to SEQ ID NO: 255
  misc_feature 1..285: note = Synthetic polypeptide
  source 1..285: mol_type = other DNA

SEQ ID NO: 1738 - DNA, 552 bp, synthetic construct; identical to SEQ ID NO: 254
  misc_feature 1..552: note = Synthetic polypeptide
  source 1..552: mol_type = other DNA

SEQ ID NO: 1739 - DNA, 847 bp, synthetic construct; identical to SEQ ID NO: 1423
  misc_feature 1..847: note = Synthetic polypeptide
  source 1..847: mol_type = other DNA

SEQ ID NO: 1740 - DNA, 793 bp, synthetic construct; identical to SEQ ID NO: 1424
  misc_feature 1..793: note = Synthetic polypeptide
  source 1..793: mol_type = other DNA

SEQ ID NO: 1741 - DNA, 418 bp, synthetic construct; identical to SEQ ID NO: 1425
  misc_feature 1..418: note = Synthetic polypeptide
  source 1..418: mol_type = other DNA

SEQ ID NO: 1742 - DNA, 798 bp, synthetic construct; identical to SEQ ID NO: 1426
  misc_feature 1..798: note = Synthetic polypeptide
  source 1..798: mol_type = other DNA

SEQ ID NO: 1743 - DNA, 3723 bp, synthetic construct
  misc_feature 1..3723: note = Synthetic polypeptide
  source 1..3723: mol_type = other DNA
atgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctggtgaggcccctgcagctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggaccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccggaaataggaaaactcaacctaaaactcacatggaatcttaagggatcccaacagccaaaacagtctcaaaaaagaagaacaaagctgaagaacttactgacttcaaaacttactacaaacctacagtaatcaaaatagtgtggtactgccatataaatcaaaagacagacatacaaaccaatggaatagactagaaagaatcccagaaataaaccctcacatatatggtcaaataattttgacaacgatgccaagactatgaaatggggaaaggatagtttttgttttagttttccaacaaatggtgctgggaaaactgaatatttgcatgcaaaagaataaagctgtgcccttacctaataccttatacaaaaattaactcaaaatggatcaaagacctaaatgtagccactgaaactataaaactcatagaagaaaacatggaacaaacccttcatggcactggatttggcagtgattagttcaccaaaggcacaggcacgaaaagaaataatagacaaattagacatcctgaaacttttaaacttttgtgcatcaaaagcaacatcaacagagtaaaaaggcaacccacagaataggagaaaatatttccaaatcatatctctgatgttaatatccagaatatatagagaactcctaaaactcaagaaaacaaacaacccagttcaaaaatgggcagag

SEQ ID NO: 1744 - DNA, 3708 bp, synthetic construct
  misc_feature 1..3708: note = Synthetic polypeptide
  source 1..3708: mol_type = other DNA
atgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctgctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggaccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccggaaataggaaaactcaacctaaaactcacatggaatcttaagggatcccaacagccaaaacagtctcaaaaaagaagaacaaagctgaagaacttactgacttcaaaacttactacaaacctacagtaatcaaaatagtgtggtactgccatataaatcaaaagacagacatacaaaccaatggaatagactagaaagaatcccagaaataaaccctcacatatatggtcaaataattttgacaacgatgccaagactatgaaatggggaaaggatagtttttgttttagttttccaacaaatggtgctgggaaaactgaatatttgcatgcaaaagaataaagctgtgcccttacctaataccttatacaaaaattaactcaaaatggatcaaagacctaaatgtagccactgaaactataaaactcatagaagaaaacatggaacaaacccttcatggcactggatttggcagtgattagttcaccaaaggcacaggcacgaaaagaaataatagacaaattagacatcctgaaacttttaaacttttgtgcatcaaaagcaacatcaacagagtaaaaaggcaacccacagaataggagaaaatatttccaaatcatatctctgatgttaatatccagaatatatagagaactcctaaaactcaagaaaacaaacaacccagttcaaaaatgggcagag

SEQ ID NO: 1745 - DNA, 3333 bp, synthetic construct
  misc_feature 1..3333: note = Synthetic polypeptide
  source 1..3333: mol_type = other DNA
atgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctgctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggacagggaaccaaccagagccagcagccccaacacaacccgtccttcctctccttcccacagccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccggaaataggaaaactcaacctaaaactcacatggaatcttaagggatcccaacagccaaaacagtctcaaaaaagaagaacaaagctgaagaacttactgacttcaaaacttactacaaacctacagtaatcaaaatagtgtggtactgccatataaatcaaaagacagacatacaaaccaatggaatagactagaaagaatcccagaaataaaccctcacatatatggtcaaataattttgacaacgatgccaagactatgaaatggggaaaggatagtttttgttttagttttccaacaaatggtgctgggaaaactgaatatttgcatgcaaaagaataaagctgtgcccttacctaataccttatacaaaaattaactcaaaatggatcaaagacctaaatgtagccactgaaactataaaactcatagaagaaaacatggaacaaacccttcatggcactggatttggcagtgattagttcaccaaaggcacaggcacgaaaagaaataatagacaaattagacatcctgaaacttttaaacttttgtgcatcaaaagcaacatcaacagagtaaaaaggcaacccacagaataggagaaaatatttccaaatcatatctctgatgttaatatccagaatatatagagaactcctaaaactcaagaaaacaaacaacccagttcaaaaatgggcagag

SEQ ID NO: 1746 - DNA, 1052 bp, synthetic construct; identical to SEQ ID NO: 247
  misc_feature 1..1052: note = Synthetic polypeptide
  source 1..1052: mol_type = other DNA

SEQ ID NO: 1747 - DNA, 327 bp, synthetic construct; identical to SEQ ID NO: 246
  misc_feature 1..327: note = Synthetic polypeptide
  source 1..327: mol_type = other DNA

SEQ ID NO: 1748 - DNA, 506 bp, synthetic construct; identical to SEQ ID NO: 1096
  misc_feature 1..506: note = Synthetic polypeptide
  source 1..506: mol_type = other DNA

SEQ ID NO: 1749 - DNA, 3934 bp, synthetic construct; identical to SEQ ID NO: 1150
  misc_feature 1..3934: note = Synthetic polypeptide
  source 1..3934: mol_type = other DNA

SEQ ID NO: 1750 - DNA, 3787 bp, synthetic construct; identical to SEQ ID NO: 1151
  misc_feature 1..3787: note = Synthetic polypeptide
  source 1..3787: mol_type = other DNA

SEQ ID NO: 1751 - DNA, 867 bp, synthetic construct; identical to SEQ ID NO: 1152
  misc_feature 1..867: note = Synthetic polypeptide
  source 1..867: mol_type = other DNA

SEQ ID NO: 1752 - DNA, 996 bp, synthetic construct; identical to SEQ ID NO: 1153
  misc_feature 1..996: note = Synthetic polypeptide
  source 1..996: mol_type = other DNA

SEQ ID NO: 1753 - DNA, 573 bp, synthetic construct; identical to SEQ ID NO: 1369
  misc_feature 1..573: note = Synthetic polypeptide
  source 1..573: mol_type = other DNA

SEQ ID NO: 1754 - DNA, 416 bp, synthetic construct; identical to SEQ ID NO: 1370
  misc_feature 1..416: note = Synthetic polypeptide
  source 1..416: mol_type = other DNA

SEQ ID NO: 1755 - DNA, 128 bp, synthetic construct; identical to SEQ ID NO: 144
  misc_feature 1..128: note = Synthetic polypeptide
  source 1..128: mol_type = other DNA

SEQ ID NO: 1756 - DNA, 1372 bp, synthetic construct
  misc_feature 1..1372: note = Synthetic polypeptide
  source 1..1372: mol_type = other DNA
atgggccgaggggtgcgcgtgctgctgctgctgagcctgctgcactgcgccgggggcagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagtaaaaatacaattagctgggcgtggtggcgggtgcctgtaatccagctactccggaggctgaggcaggagaatcgcttgaacctgggagacagaggttatggtgagtcgagattgcaacattgcactccatcctgggggcaacaagagtgaaactccatctcaaaaaaaaaagaaaaaaaaaaaaaga

SEQ ID NO: 1757 - DNA, 2501 bp, synthetic construct; identical to SEQ ID NO: 1164
  misc_feature 1..2501: note = Synthetic polypeptide
  source 1..2501: mol_type = other DNA

SEQ ID NO: 1758 - DNA, 2552 bp, synthetic construct; identical to SEQ ID NO: 1165
  misc_feature 1..2552: note = Synthetic polypeptide
  source 1..2552: mol_type = other DNA

SEQ ID NO: 1759 - DNA, 2456 bp, synthetic construct; identical to SEQ ID NO: 1166
  misc_feature 1..2456: note = Synthetic polypeptide
  source 1..2456: mol_type = other DNA

SEQ ID NO: 1760 - DNA, 588 bp, synthetic construct; identical to SEQ ID NO: 1167
  misc_feature 1..588: note = Synthetic polypeptide
  source 1..588: mol_type = other DNA

SEQ ID NO: 1761 - DNA, 1730 bp, synthetic construct
  misc_feature 1..1730: note = Synthetic polypeptide
  source 1..1730: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttca

SEQ ID NO: 1762 - DNA, 1733 bp, synthetic construct
  misc_feature 1..1733: note = Synthetic polypeptide
  source 1..1733: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttca

SEQ ID NO: 1763 - DNA, 1834 bp, synthetic construct; identical to SEQ ID NO: 133
  misc_feature 1..1834: note = Synthetic polypeptide
  source 1..1834: mol_type = other DNA

SEQ ID NO: 1764 - DNA, 1765 bp, synthetic construct; identical to SEQ ID NO: 135
  misc_feature 1..1765: note = Synthetic polypeptide
  source 1..1765: mol_type = other DNA

SEQ ID NO: 1765 - DNA, 92 bp, synthetic construct
  misc_feature 1..92: note = Synthetic polypeptide
  source 1..92: mol_type = other DNA
atggacgggcgccgcgtccctgcacagcccgccgcagagggagctcagtgtctgtttgtccagcttctcagagttgctgtgcagctcggatg

SEQ ID NO: 1766 - DNA, 2567 bp, synthetic construct
  misc_feature 1..2567: note = Synthetic polypeptide
  source 1..2567: mol_type = other DNA
atggcggcgggctcggatctgctggacgaggtcttcttcaacagcgaggtggacgagaaagtggtgagcgacctggtgggctcgctggagtcgcagctggcggccagcgcggcccaccaccaccacctcgcgccgcgcacgcccgaggtgcgggccgcggccgccggcgcgctcgggaaccatgttgtgagcggcagcccggccggagccgcgggcgcagggccggccgcccccgccgagggcgcgcccggagcggcgccggagccgccccccgcaggtagagcgcggccggggggcggggggccgcagcgcccgggccccccctcaccgcgccgcccccttgtccccgcagggcccgcgccgcccgccgcgaagctgaggccgccgcccgagggcagcgcggggtcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccggcactgtcatccagacgccccccttcgtgggcgccgccgcgccccccgcgcccgccgcgccctcgccccccgccgcccccgcgcccgccgcccccgccgccgccccgcccccgccaccccccgcgcccgccactctggcccggccgcccggccaccccgccggacccccgaccgccgcgcccgccgtgccgccccccgccgccgcccagaacgggggcagcgccggggcagcccccgcccccgccccggccgccgggggccccgcgggggtcagcggccaacccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcggactcctgagagaaaaggctgattgcgggactgggataaggaaatacaagatgagcggagaccgtcctgtgtcagagagca

SEQ ID NO: 1767 - DNA, 572 bp, synthetic construct
  misc_feature 1..572: note = Synthetic polypeptide
  source 1..572: mol_type = other DNA
gtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcggactcctgagagaaaaggctgattgcgggactgggataaggaaatacaagatgagcggagaccgtcctgtgtcagagagca

SEQ ID NO: 1768 - DNA, 569 bp, synthetic construct
  misc_feature 1..569: note = Synthetic polypeptide
  source 1..569: mol_type = other DNA
atggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaaaacccagtgctttggtgtttgga

SEQ ID NO: 1769 - DNA, 497 bp, synthetic construct
  misc_feature 1..497: note = Synthetic polypeptide
  source 1..497: mol_type = other DNA
atggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaaaacccagtgctttggtgtttgga

SEQ ID NO: 1770 - DNA, 1718 bp, synthetic construct
  misc_feature 1..1718: note = Synthetic polypeptide
  source 1..1718: mol_type = other DNA
atggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggtctgactcaaccttccagatctcagcctaacatcacctcctcagagaagccctccatcactgcccagatgccatccagcgccccatttcatcttctccttgtgtcttgcccttctgcatagcatttatcacaattatcattttttaagtgttatggagtaattgggtatttactacctctacattgagctagaaagtaagttccttgagggtgaagatcttgccatgatctctgctgtgtccccagcgcctggcacacagtaggtactcaagagctgtttgttggatga

SEQ ID NO: 1771 - DNA, 1700 bp, synthetic construct
  misc_feature 1..1700: note = Synthetic polypeptide
  source 1..1700: mol_type = other DNA
atgtgggttccagtcctagccctgcctgtgtgcacttatgcagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggtctgactcaaccttccagatctcagcctaacatcacctcctcagagaagccctccatcactgcccagatgccatccagcgccccatttcatcttctccttgtgtcttgcccttctgcatagcatttatcacaattatcattttttaagtgttatggagtaattgggtatttactacctctacattgagctagaaagtaagttccttgagggtgaagatcttgccatgatctctgctgtgtccccagcgcctggcacacagtaggtactcaagagctgtttgttggatga

SEQ ID NO: 1772 - DNA, 366 bp, synthetic construct
  misc_feature 1..366: note = Synthetic polypeptide
  source 1..366: mol_type = other DNA
atggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagccactgtatggttgggcaggttgtgtactgcacaaggatttccagccaagcaggcaagtaataggtgaaactgtctgtgccctgctcatcaagcacatatcctggtg

SEQ ID NO: 1773 - DNA, 5505 bp, synthetic construct; identical to SEQ ID NO: 1545
  misc_feature 1..5505: note = Synthetic polypeptide
  source 1..5505: mol_type = other DNA

SEQ ID NO: 1774 - DNA, 5418 bp, synthetic construct; identical to SEQ ID NO: 1546
  misc_feature 1..5418: note = Synthetic polypeptide
  source 1..5418: mol_type = other DNA

SEQ ID NO: 1775 - DNA, 2138 bp, synthetic construct
  misc_feature 1..2138: note = Synthetic polypeptide
  source 1..2138: mol_type = other DNA
atgatgttttggaggaaactccccaaagccctcttcattgggctgactctggccattgctgtcaatctccttctggtattttctagcaaggggactttacaaaacctgtttacgggtggtctccacagggagcttcctttacatctgaataaacgctacggggcagtgataaagagactctcccacttggaggtggaattgcaggatctgaaagaaagtatgaaattagctctgaggcaacaagaaaatgtgaacagcacactgaagagggcgaaagatgaagtacgccctcttctaaaggcaatggaaaccaaggtgaatgagacaaagaagcacaaaacccaaatgaaactcttcccacactcacagcttttcaggcaatggggcgaggatctttctgaggcccagcagaaggcggcccaggacctcttccggaagtttggttacaacgcgtacctcagcaaccagctgcctctcaatcgcaccatccccgacacgcgagactacagatgtcttcggaagacatatccttcccaactcccatccctcagtgtcattctcatattcgtgaatgaagctctgtccattatacaacgggccatcaccagtatcatcaaccggacgccctctcgattgttgaaggaaatcatcttggtggatgatttcagctcaaatggagaactaaaggtacacttggatgagaagattaagctttacaaccagaagtatccaggactactgaaaataatacggcatcctgaaaggaaaggtcttgctcaagcccgcaacactggctgggaagctgccacagcagacgtggtcgccatcttggatgctcacattgaagtcaatgttgggtgggcagagccaatcttggctcggattcaggaggaccgcactgtgattgtgtctcctgtgtttgacaacattcgttttgacaccttcaaactggataagtatgaactggcagttgatgggtttaactgggaactctggtgccgctacgatgcactgccacaagcctggattgatctgcatgatgtcactgccccagtgaagagtccttcaatcatgggcatcctggctgctaacaggcacttcctgggagagatcgggtctctggatggtggaatgctcatctatggaggagagaacgtggagcttagcctgagggtgtggcagtgtggagggaaggtcgagattttgccctgttcccggattgcccacctagagagacaccacaagccctacgccttggatctcaccgctgccttgaagcgcaatgctctgcgagtggccgaaatctggatggatgagcacaaacacatggtctacttggcctggaacatacctctccagaactctggaatagattttggagacgtttcttccagaatggcactccgggaaaaactgaaatgtaaaacttttgactggtacctgaaaaatgtttatccactcttgaagccactccacaccatcgtgggctatggaagaatgaaaaacctattggatgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccgaacctgaacctataatcttgaggagacatcaatcaaacccaaattgagggacattcttcaaaagaaatggtctgtatgcttcaaaaatatcaactcatggaagacaagactgaggaagtgttccagatttaaggggactaacgagataactaaatgtaatgtgtgatcctggattagatcctggacctgagggctttttccccctttgattgtaaaggacagcagtagacaataggtgaaagttgaagaaggtttgttgattagataatagcattgtatcctgattttgatcattgtactctggctatataagagaatgttctttattttacaaaatagtcactggatggagttgaggggaagggacattatctctg

SEQ ID NO: 1776 - DNA, 688 bp, synthetic construct
  misc_feature 1..688: note = Synthetic polypeptide
  source 1..688: mol_type = other DNA
tttatccactcttgaagccactccacaccatcgtgggctatggaagaatgaaaaacctattggatgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccgaacctgaacctataatcttgaggagacatcaatcaaacccaaattgagggacattcttcaaaagaaatggtctgtatgcttcaaaaatatcaactcatggaagacaagactgaggaagtgttccagatttaaggggactaacgagataactaaatgtaatgtgtgatcctggattagatcctggacctgagggctttttccccctttgattgtaaaggacagcagtagacaataggtgaaagttgaagaaggtttgttgattagataatagcattgtatcctgattttgatcattgtactctggctatataagagaatgttctttattttacaaaatagtcactggatggagttgaggggaagggacattatctctg

SEQ ID NO: 1777 - DNA, 625 bp, synthetic construct
  misc_feature 1..625: note = Synthetic polypeptide
  source 1..625: mol_type = other DNA
atgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccgaacctgaacctataatcttgaggagacatcaatcaaacccaaattgagggacattcttcaaaagaaatggtctgtatgcttcaaaaatatcaactcatggaagacaagactgaggaagtgttccagatttaaggggactaacgagataactaaatgtaatgtgtgatcctggattagatcctggacctgagggctttttccccctttgattgtaaaggacagcagtagacaataggtgaaagttgaagaaggtttgttgattagataatagcattgtatcctgattttgatcattgtactctggctatataagagaatgttctttattttacaaaatagtcactggatggagttgaggggaagggacattatctctg

SEQ ID NO: 1778 - DNA, 77 bp, synthetic construct
  misc_feature 1..77: note = Synthetic polypeptide
  source 1..77: mol_type = other DNA
atgccgccgaagttcgaccccaacgagatcaaagtcgcttcttcacgtgtaggtggggagggaggactggaccacct

SEQ ID NO: 1779 - DNA, 586 bp, synthetic construct; identical to SEQ ID NO: 401
  misc_feature 1..586: note = Synthetic polypeptide
  source 1..586: mol_type = other DNA

SEQ ID NO: 1780 - DNA, 829 bp, synthetic construct; identical to SEQ ID NO: 402
  misc_feature 1..829: note = Synthetic polypeptide
  source 1..829: mol_type = other DNA

SEQ ID NO: 1781 - DNA, 1060 bp, synthetic construct; identical to SEQ ID NO: 403
  misc_feature 1..1060: note = Synthetic polypeptide
  source 1..1060: mol_type = other DNA

SEQ ID NO: 1782 - DNA, 730 bp, synthetic construct; identical to SEQ ID NO: 406
  misc_feature 1..730: note = Synthetic polypeptide
  source 1..730: mol_type = other DNA

SEQ ID NO: 1783 - DNA, 496 bp, synthetic construct; identical to SEQ ID NO: 408
  misc_feature 1..496: note = Synthetic polypeptide
  source 1..496: mol_type = other DNA

SEQ ID NO: 1784 - DNA, 1068 bp, synthetic construct; identical to SEQ ID NO: 1221
  misc_feature 1..1068: note = Synthetic polypeptide
  source 1..1068: mol_type = other DNA

SEQ ID NO: 1785 - DNA, 1199 bp, synthetic construct
  misc_feature 1..1199: note = Synthetic polypeptide
  source 1..1199: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttca

SEQ ID NO: 1786 - DNA, 901 bp, synthetic construct
  misc_feature 1..901: note = Synthetic polypeptide
  source 1..901: mol_type = other DNA
taatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttca

SEQ ID NO: 1787 - DNA, 1015 bp, synthetic construct
  misc_feature 1..1015: note = Synthetic polypeptide
  source 1..1015: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccatggaggatgaggagg

SEQ ID NO: 1788 - DNA, 1018 bp, synthetic construct
  misc_feature 1..1018: note = Synthetic polypeptide
  source 1..1018: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccatggaggatgaggagg

SEQ ID NO: 1789 - DNA, 465 bp, synthetic construct
  misc_feature 1..465: note = Synthetic polypeptide
  source 1..465: mol_type = other DNA
taatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctcagagccacccaaacccttcatcaccagcaacaactccaaccccatggaggatgaggagg

SEQ ID NO: 1790 - DNA, 1032 bp, synthetic construct
  misc_feature 1..1032: note = Synthetic polypeptide
  source 1..1032: mol_type = other DNA
atggcggcgcacaggaagcacgatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgccagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacgcttggggcagaccaacagtcatgccaggagtaaccagaaagccaggatgggaaacacctgttgaagggatcaggaagctactcaggaaaacagctcatagaaagatggaactcctggaaccctcacggggagattatcatggaaacatctgcagccacttgtcttcaggaatctgcaagtcctgtgtgtgggcgttgggtgagggtctggggaaaggacctggtggagcccagagaggcagaaaaaccagc

SEQ ID NO: 1791 - DNA, 289 bp, synthetic construct
  misc_feature 1..289: note = Synthetic polypeptide
  source 1..289: mol_type = other DNA
ttttttgaagtcaacacaggaaatgtatttttatgacgcttggggcagaccaacagtcatgccaggagtaaccagaaagccaggatgggaaacacctgttgaagggatcaggaagctactcaggaaaacagctcatagaaagatggaactcctggaaccctcacggggagattatcatggaaacatctgcagccacttgtcttcaggaatctgcaagtcctgtgtgtgggcgttgggtgagggtctggggaaaggacctggtggagcccagagaggcagaaaaaccagc

SEQ ID NO: 1792 - DNA, 1314 bp, synthetic construct
  misc_feature 1..1314: note = Synthetic polypeptide
  source 1..1314: mol_type = other DNA
atggcggcgcacaggaagcacgtgtttgtggagaaggtgctgcagagactttttcctcctgttccaagtggccaaggaaagagggaaccccagacgctggccgtccaaaatccaccaaagaaagtgacctctgagaaagtgagccagaaacatgctgagcctttgacagacactggctctgagaccccgactgcccgacggctctacactgccagcgggcctcctgagggctacgtcccctgttggccggagcccagcagctgtgggagccccgagaacgcctccagcggggatgacacagaagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgccagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacgcttggggcagaccaacagtcatgccaggagtaaccagaaagccaggatgggaaacacctgttgaagggatcaggaagctactcaggaaaacagctcatagaaagatggaactcctggaaccctcacggggagattatcatggaaacatctgcagccacttgtcttcaggaatctgcaagtcctgtgtgtgggcgttgggtgagggtctggggaaaggacctggtggagcccagagaggcagaaaaaccagc

SEQ ID NO: 1793 - DNA, 620 bp, synthetic construct
  misc_feature 1..620: note = Synthetic polypeptide
  source 1..620: mol_type = other DNA
aagatggtgcggacgctagcgaggaagacctgacacgggccaggcaggaagagggtgcggacgccagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacgcttggggcagaccaacagtcatgccaggagtaaccagaaagccaggatgggaaacacctgttgaagggatcaggaagctactcaggaaaacagctcatagaaagatggaactcctggaaccctcacggggagattatcatggaaacatctgcagccacttgtcttcaggaatctgcaagtcctgtgtgtgggcgttgggtgagggtctggggaaaggacctggtggagcccagagaggcagaaaaaccagc

SEQ ID NO: 1794 - DNA, 2437 bp, synthetic construct
  misc_feature 1..2437: note = Synthetic polypeptide
  source 1..2437: mol_type = other DNA
atgctgtcccttcagtaccccgacgtgtaccgcgacgagaccgccgtacaggattatcatggtcataaaatttgtgacccttacgcctggcttgaagaccccgacagtgaacagactaaggcctttgtggaggcccagaataagattactgtgccatttcttgagcagtgtcccatcagaggtttatacaaagagagaatgactgaactatatgattatcccaagtatagttgccacttcaagaaaggaaaacggtatttttatttttacaatacaggtttgcagaaccagcgagtattatatgtacaggattccttagagggtgaggccagagtgttcctggaccccaacatactgtctgacgatggcacagtggcactccgaggttatgcgttcagcgaagatggtgaatattttgcctatggtctgagtgccagtggctcagactgggtgacaatcaagttcatgaaagttgatggtgccaaagagcttccagatgtgcttgaaagagtcaagttcagctgtatggcctggacccatgatgggaagggaatgttctacaactcataccctcaacaggatggaaaaagtgatggcacagagacatctaccaatctccaccaaaagctctactaccatgtcttgggaaccgatcagtcagaagatattttgtgtgctgagtttcctgatgaacctaaatggatgggtggagctgagttatctgatgatggccgctatgtcttgttatcaataagggaaggatgtgatccagtaaaccgactctggtactgtgacctacagcaggaatccagtggcatcgcgggaatcctgaagtgggtaaaactgattgacaactttgaaggggaatatgactacgtgaccaatgaggggacggtgttcacattcaagacgaatcgccagtctcccaactatcgcgtgatcaacattgacttcagggatcctgaagagtctaagtggaaagtacttgttcctgagcatgagaaagatgtcttagaatggatagcttgtgtcaggtccaacttcttggtcttatgctacctccatgacgtcaagaacattctgcagctccatgacctgactactggtgctctccttaagaccttcccgctcgatgtcggcagcattgtagggtacagcggtcagaagaaggacactgaaatcttctatcagtttacttcctttttatctccaggtatcatttatcactgtgatcttaccaaagaggagctggagccaagagttttccgagaggtgaccgtaaaaggaattgatgcttctgattaccagacagtccagattcctcgttttttaaaaactgaaggtttgaagcaaccttgtgttgaacaagtctgttaccaccattttcccaacagcatgtgctcagttcgtgtctgtcacattttgataattctcacaatgtttcaagctttttcattattacatcacagtgagctttgatgtgacgatcgtcattgttctggggcatcacaaatgcgctcatagaaggtggtgaacttaactgaaaaatgctgtgtgtgttctgactgctccatccgtcagctataccctcatctctctccctctcgtcagaccgccctattccctgagacataacactgttaaaattaggccaaataataaccctacagtggcctccaaatgttcaaatgcaaggaaaacatgcacatctctcactttaaatcaaaagctagaaattattatgcttagtgaggaaggtatgtcaaaagccaaaataagccaaaagctataggtgcctcttgcaccaaacagccaacttgtgaatgcaaaggaaaagttcttgaaagaaataaaaagtgctatgccagtgaacacatgaatggtaagaaagcaaaacagccttattgctgatatggagaaagtttgagtggtctggatagaagatgaaaccagctgcaaccttcccttaagccaaggcctaatccatagcaaagccctaactttcttcagttctgtgaagactaaaagacatgagaaagctgcagaacattagggagctagcagaggttggttcatgaagtttaaggaacgaagccatctgcacaacataaaagttcaaggtgaagcagcaagtgctgatgtagaagctgcagcaagttatcctgaagatctagctaaaataattgatgaaggtggctgtactaaaacattttcaatataggcagaacagccttctgttggaagaagatgtcatctaggactttcatagctaaagagaagtctgcctggcttcaaagttccaaagtttcaaagttccaaagttccaaaggacaggttgattctattaggggctaatgcagctggtgattttaagttgaagctagtgcacatttaccattcttaaaatcctagggcccttaagaattgtgctaaatta

SEQ ID NO: 1795 - DNA, 1224 bp, synthetic construct
  misc_feature 1..1224: note = Synthetic polypeptide
  source 1..1224: mol_type = other DNA
gtatcatttatcactgtgatcttaccaaagaggagctggagccaagagttttccgagaggtgaccgtaaaaggaattgatgcttctgattaccagacagtccagattcctcgttttttaaaaactgaaggtttgaagcaaccttgtgttgaacaagtctgttaccaccattttcccaacagcatgtgctcagttcgtgtctgtcacattttgataattctcacaatgtttcaagctttttcattattacatcacagtgagctttgatgtgacgatcgtcattgttctggggcatcacaaatgcgctcatagaaggtggtgaacttaactgaaaaatgctgtgtgtgttctgactgctccatccgtcagctataccctcatctctctccctctcgtcagaccgccctattccctgagacataacactgttaaaattaggccaaataataaccctacagtggcctccaaatgttcaaatgcaaggaaaacatgcacatctctcactttaaatcaaaagctagaaattattatgcttagtgaggaaggtatgtcaaaagccaaaataagccaaaagctataggtgcctcttgcaccaaacagccaacttgtgaatgcaaaggaaaagttcttgaaagaaataaaaagtgctatgccagtgaacacatgaatggtaagaaagcaaaacagccttattgctgatatggagaaagtttgagtggtctggatagaagatgaaaccagctgcaaccttcccttaagccaaggcctaatccatagcaaagccctaactttcttcagttctgtgaagactaaaagacatgagaaagctgcagaacattagggagctagcagaggttggttcatgaagtttaaggaacgaagccatctgcacaacataaaagttcaaggtgaagcagcaagtgctgatgtagaagctgcagcaagttatcctgaagatctagctaaaataattgatgaaggtggctgtactaaaacattttcaatataggcagaacagccttctgttggaagaagatgtcatctaggactttcatagctaaagagaagtctgcctggcttcaaagttccaaagtttcaaagttccaaagttccaaaggacaggttgattctattaggggctaatgcagctggtgattttaagttgaagctagtgcacatttaccattcttaaaatcctagggcccttaagaattgtgctaaatta

SEQ ID NO: 1796 - DNA, 392 bp, synthetic construct; identical to SEQ ID NO: 410
  misc_feature 1..392: note = Synthetic polypeptide
  source 1..392: mol_type = other DNA

SEQ ID NO: 1797 - DNA, 411 bp, synthetic construct
  misc_feature 1..411: note = Synthetic polypeptide
  source 1..411: mol_type = other DNA
atgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtctcttgccctgtgcagcttcctgcagactggacttgcaaagtccagcctgtatggctggagttcccatgcctgccaatctcctgtcgactgcgagtcagctccgatacttcaccagattcagactcatgaaagacc

SEQ ID NO: 1798 - DNA, 411 bp, synthetic construct; identical to SEQ ID NO: 1797
  misc_feature 1..411: note = Synthetic polypeptide
  source 1..411: mol_type = other DNA

SEQ ID NO: 1799 - DNA, 724 bp, synthetic construct
  misc_feature 1..724: note = Synthetic polypeptide
  source 1..724: mol_type = other DNA
atgtgtaaaatggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggaggtcctggaaccgatcctctgtaaatactgaagaatacctg

SEQ ID NO: 1800 - DNA, 814 bp, synthetic construct
  misc_feature 1..814: note = Synthetic polypeptide
  source 1..814: mol_type = other DNA
atggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggaggtcctggaaccgatcctctgtaaatactgaagaatacctg

SEQ ID NO: 1801 - DNA, 263 bp, synthetic construct
  misc_feature 1..263: note = Synthetic polypeptide
  source 1..263: mol_type = other DNA
atggggccgtcctcttgcctccttctcatcctaatcccccttctccagctgatcaacccggggagtactcagtgttccttagactccgttatggataagaagatcaaggatgttctcaacagtctagagtacagtccctctcctataagcaagaagctctcgtgtgctagtgtcaaaagccaaggcagaccgtcctcctgccctgctggtattctctgtcatagccaccctcccaccttgaggccttcctacgtcctgtctcc

SEQ ID NO: 1802 - DNA, 2466 bp, synthetic construct; identical to SEQ ID NO: 1682
  misc_feature 1..2466: note = Synthetic polypeptide
  source 1..2466: mol_type = other DNA

SEQ ID NO: 1803 - DNA, 1806 bp, synthetic construct; identical to SEQ ID NO: 1683
  misc_feature 1..1806: note = Synthetic polypeptide
  source 1..1806: mol_type = other DNA

SEQ ID NO: 1804 - DNA, 2412 bp, synthetic construct; identical to SEQ ID NO: 1684
  misc_feature 1..2412: note = Synthetic polypeptide
  source 1..2412: mol_type = other DNA

SEQ ID NO: 1805 - DNA, 2211 bp, synthetic construct; identical to SEQ ID NO: 1685
  misc_feature 1..2211: note = Synthetic polypeptide
  source 1..2211: mol_type = other DNA

SEQ ID NO: 1806 - DNA, 364 bp, synthetic construct; identical to SEQ ID NO: 1686
  misc_feature 1..364: note = Synthetic polypeptide
  source 1..364: mol_type = other DNA

SEQ ID NO: 1807 - DNA, 1117 bp, synthetic construct
  misc_feature 1..1117: note = Synthetic polypeptide
  source 1..1117: mol_type = other DNA
atggttagtaatttcttccatgtcatacaagtattcgagaaatctgctaccttgattagtaagactgaacacattggttttgtcatttattcatggaggaagtccaccacccacttggggagcagaaggaaatttgccatctcaatttacttatcagaagtttctttgcagaaatatgattgtcccttcagtgggacatcatttgtggtcttctctctctttttgatctgtgcaatggctggagatgtagtctacgctgacatcaaaactgttcggacttccccgttagaactcgcgtttccacttcagagatctgtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatggccccatcaccagagtggcagagcagcagagcagcggaatagcagagtgacagagaaagaaagaaaagaagaagcagccggatgtcagagagaagcagtttgagctcagagggacagcttgatggtgggacctcggagaagagtttgtctgaactccaggggaataccaccttcccattccatccactttccagctccctatcccgctgagagccacttccatccctcaataaaatcctccacattcactacccttcaatttgtttgcatgacctgattcttcctggacgctaaacaagaactgaggtaccaagaaggcaggtccaaaaggctgtcaccctgaccctccactgagctgttaaatacttgtcatctgtggatagaaaagctaaaagagcacactgtaacactcaccctctggggcttgaggggtcatgggaactcccctagatgttgccatggggcagcacagagttctactcctgctggcacacagaagccctcatcctgatccctacacccactcacctgtgagtttcccctcccatgaggggttgagagctgtgggctgagtaaacaagccaacccctttgcaactcctgcaaagaggccagggaagtaccccatttca

SEQ ID NO: 1808 - DNA, 649 bp, synthetic construct
  misc_feature 1..649: note = Synthetic polypeptide
  source 1..649: mol_type = other DNA
caagacattactgctatggccccatcaccagagtggcagagcagcagagcagcggaatagcagagtgacagagaaagaaagaaaagaagaagcagccggatgtcagagagaagcagtttgagctcagagggacagcttgatggtgggacctcggagaagagtttgtctgaactccaggggaataccaccttcccattccatccactttccagctccctatcccgctgagagccacttccatccctcaataaaatcctccacattcactacccttcaatttgtttgcatgacctgattcttcctggacgctaaacaagaactgaggtaccaagaaggcaggtccaaaaggctgtcaccctgaccctccactgagctgttaaatacttgtcatctgtggatagaaaagctaaaagagcacactgtaacactcaccctctggggcttgaggggtcatgggaactcccctagatgttgccatggggcagcacagagttctactcctgctggcacacagaagccctcatcctgatccctacacccactcacctgtgagtttcccctcccatgaggggttgagagctgtgggctgagtaaacaagccaacccctttgcaactcctgcaaagaggccagggaagtaccccatttca

SEQ ID NO: 1809 - DNA, 972 bp, synthetic construct
  misc_feature 1..972: note = Synthetic polypeptide
  source 1..972: mol_type = other DNA
tttacttatcagaagtttctttgcagaaatatgattgtcccttcagtgggacatcatttgtggtcttctctctctttttgatctgtgcaatggctggagatgtagtctacgctgacatcaaaactgttcggacttccccgttagaactcgcgtttccacttcagagatctgtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatggccccatcaccagagtggcagagcagcagagcagcggaatagcagagtgacagagaaagaaagaaaagaagaagcagccggatgtcagagagaagcagtttgagctcagagggacagcttgatggtgggacctcggagaagagtttgtctgaactccaggggaataccaccttcccattccatccactttccagctccctatcccgctgagagccacttccatccctcaataaaatcctccacattcactacccttcaatttgtttgcatgacctgattcttcctggacgctaaacaagaactgaggtaccaagaaggcaggtccaaaaggctgtcaccctgaccctccactgagctgttaaatacttgtcatctgtggatagaaaagctaaaagagcacactgtaacactcaccctctggggcttgaggggtcatgggaactcccctagatgttgccatggggcagcacagagttctactcctgctggcacacagaagccctcatcctgatccctacacccactcacctgtgagtttcccctcccatgaggggttgagagctgtgggctgagtaaacaagccaacccctttgcaactcctgcaaagaggccagggaagtaccccatttca

SEQ ID NO: 1810 - DNA, 1221 bp, synthetic construct; identical to SEQ ID NO: 122
  misc_feature 1..1221: note = Synthetic polypeptide
  source 1..1221: mol_type = other DNA

SEQ ID NO: 1811 - DNA, 1420 bp, synthetic construct; identical to SEQ ID NO: 924
  misc_feature 1..1420: note = Synthetic polypeptide
  source 1..1420: mol_type = other DNA

SEQ ID NO: 1812 - DNA, 1336 bp, synthetic construct; identical to SEQ ID NO: 925
  misc_feature 1..1336: note = Synthetic polypeptide
  source 1..1336: mol_type = other DNA

SEQ ID NO: 1813 - DNA, 1069 bp, synthetic construct; identical to SEQ ID NO: 926
  misc_feature 1..1069: note = Synthetic polypeptide
  source 1..1069: mol_type = other DNA

SEQ ID NO: 1814 - DNA, 1345 bp, synthetic construct; identical to SEQ ID NO: 927
  misc_feature 1..1345: note = Synthetic polypeptide
  source 1..1345: mol_type = other DNA

SEQ ID NO: 1815 - DNA, 316 bp, synthetic construct
  misc_feature 1..316: note = Synthetic polypeptide
  source 1..316: mol_type = other DNA
atgcctggtccgacccccagtggcactaacgtgggatcctcagggcgctctcccagcaaagcagtggccgcccgggcggcgggatccactgtccggcagagggaggaaaaaatcttgaacacatgcatggaaacttctgaaggatgtgaagagggatgtgacattttctggctgcaacaggtaaatctaaaactgatgatttgaacttacatgaaatatttcacatcagaacaaagacattctaatagaactggcagaaatgtaaaattatcctgaatgattttgagttccctgtcattgggatgttcatgaggag

SEQ ID NO: 1816 - DNA, 528 bp, synthetic construct; identical to SEQ ID NO: 1280
  misc_feature 1..528: note = Synthetic polypeptide
  source 1..528: mol_type = other DNA

SEQ ID NO: 1817 - DNA, 438 bp, synthetic construct; identical to SEQ ID NO: 1281
  misc_feature 1..438: note = Synthetic polypeptide
  source 1..438: mol_type = other DNA

SEQ ID NO: 1818 - DNA, 1206 bp, synthetic construct; identical to SEQ ID NO: 282
  misc_feature 1..1206: note = Synthetic polypeptide
  source 1..1206: mol_type = other DNA

SEQ ID NO: 1819 - DNA, 1209 bp, synthetic construct; identical to SEQ ID NO: 281
  misc_feature 1..1209: note = Synthetic polypeptide
  source 1..1209: mol_type = other DNA

SEQ ID NO: 1820 - DNA, 1203 bp, synthetic construct; identical to SEQ ID NO: 286
  misc_feature 1..1203: note = Synthetic polypeptide
  source 1..1203: mol_type = other DNA

SEQ ID NO: 1821 - DNA, 1146 bp, synthetic construct; identical to SEQ ID NO: 988
  misc_feature 1..1146: note = Synthetic polypeptide
  source 1..1146: mol_type = other DNA

SEQ ID NO: 1822 - DNA, 1033 bp, synthetic construct
  misc_feature 1..1033: note = Synthetic polypeptide
  source 1..1033: mol_type = other DNA
atgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacaggtgacaaggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggcca

SEQ ID NO: 1823 - DNA, 1075 bp, synthetic construct
  misc_feature 1..1075: note = Synthetic polypeptide
  source 1..1075: mol_type = other DNA
atgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggcca

SEQ ID NO: 1824 - DNA, 317 bp, synthetic construct; identical to SEQ ID NO: 995
  misc_feature 1..317: note = Synthetic polypeptide
  source 1..317: mol_type = other DNA

SEQ ID NO: 1825 - DNA, 1141 bp, synthetic construct
  misc_feature 1..1141: note = Synthetic polypeptide
  source 1..1141: mol_type = other DNA
atggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaaggcctgcttcctcatggtctggtgaggaggcaggacagatggacatgtaggggctctcacag

SEQ ID NO: 1826 - DNA, 1031 bp, synthetic construct
  misc_feature 1..1031: note = Synthetic polypeptide
  source 1..1031: mol_type = other DNA
atgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcagaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgccaggtatggtggtgcatgcctatagtcccagctgtttgggaggctgaggcagaagaatcgcttgaacccaggaggcacaggttgcagtaggccgagattgtgccactgcactccagcctgggtggcagagtgagactccatctccaaaacaacaacaacaacaaa

SEQ ID NO: 1827 - DNA, 2409 bp, synthetic construct; identical to SEQ ID NO: 1481
  misc_feature 1..2409: note = Synthetic polypeptide
  source 1..2409: mol_type = other DNA

SEQ ID NO: 1828 - DNA, 1083 bp, synthetic construct
  misc_feature 1..1083: note = Synthetic polypeptide
  source 1..1083: mol_type = other DNA
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggaggggttctttgctccgtctctactgtttcaaatactgcccaacctcaaagcccagctccaaagctacctcctctgtgaagaactccttg

SEQ ID NO: 1829 - DNA, 495 bp, synthetic construct
  misc_feature 1..495: note = Synthetic polypeptide
  source 1..495: mol_type = other DNA
atgcataatctgtattccatcactgggtacccggacccaccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccagatgcccagtcatccctttggagaggctcacatggcaaggaactgaggcctcccaccaacagccatgtgagtgcatcatcttggaagcagatcctctagccccagtcaagcctgcagatgacttgcagtcccaggcaacatcttgactacaatcacgcaagagatctcaagctagaactacccagctaagctgctctcagattcctgaaccacagaaactgtgagataataaatgcttatggttgttttaagtcactgcgttttggggtaattggttgtgcagccatagataactga

SEQ ID NO: 1830 - DNA, 909 bp, synthetic construct
  misc_feature 1..909: note = Synthetic polypeptide
  source 1..909: mol_type = other DNA
ctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtatctttgcttatcttgcccagtacccgatgccacgtggaaatggagtggctcttaattaaggtaagaacatgtgttaggcctctttaccttcatgttaaaataacaattctgatttctaaagcatatgaatcgttactatggagaattagcaatccacaaccctgtgcaattaacttttatccaacttctataaaaatcctggctaagacatagtgatatttaaagaaaagagtctacagacatgctatccattctagatatttggagttctatccccagatctaattagagcaccagaagcctac

SEQ ID NO: 1831 - DNA, 963 bp, synthetic construct
  misc_feature 1..963: note = Synthetic polypeptide
  source 1..963: mol_type = other DNA
atggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtatctttgcttatcttgcccagtacccgatgccacgtggaaatggagtggctcttaattaaggtaagaacatgtgttaggcctctttaccttcatgttaaaataacaattctgatttctaaagcatatgaatcgttactatggagaattagcaatccacaaccctgtgcaattaacttttatccaacttctataaaaatcctggctaagacatagtgatatttaaagaaaagagtctacagacatgctatccattctagatatttggagttctatccccagatctaattagagcaccagaagcctac

SEQ ID NO: 1832 - DNA, 876 bp, synthetic construct
  misc_feature 1..876: note = Synthetic polypeptide
  source 1..876: mol_type = other DNA
atggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtatctttgcttatcttgcccagtacccgatgccacgtggaaatggagtggctcttaattaaggtaagaacatgtgttaggcctctttaccttcatgttaaaataacaattctgatttctaaagcatatgaatcgttactatggagaattagcaatccacaaccctgtgcaattaacttttatccaacttctataaaaatcctggctaagacatagtgatatttaaagaaaagagtctacagacatgctatccattctagatatttggagttctatccccagatctaattagagcaccagaagcctac

SEQ ID NO: 1833 - DNA, 417 bp, synthetic construct
  misc_feature 1..417: note = Synthetic polypeptide
  source 1..417: mol_type = other DNA
atgcataatctgtattccatcactgggtacccggacccaccagggaccatggaggaggaggaggaggatgatgactatgagaactcaacacctccctacaaggaccttcctcccaagccagatgcccagtcatccctttggagaggctcacatggcaaggaactgaggcctcccaccaacagccatgtgagtgcatcatcttggaagcagatcctctagccccagtcaagcctgcagatgacttgcagtcccaggcaacatcttgactacaatcacgcaagagatctcaagctagaactacccagctaagctgctctcagattcctgaaccacagaaactgtgagataataaatgcttatggttgttttaagtcactgcgttttggggtaattggttgtgcagccatagataactga

SEQ ID NO: 1834 - DNA, 417 bp, synthetic construct; identical to SEQ ID NO: 1833
  misc_feature 1..417: note = Synthetic polypeptide
  source 1..417: mol_type = other DNA

SEQ ID NO: 1835 - DNA, 432 bp, synthetic construct
  misc_feature 1..432: note = Synthetic polypeptide
  source 1..432: mol_type = other DNA
atgcctcacagctccgacagcagtgactccagcttcagccgctctcctccccctggcaaacaggactcatctgatgatgtgagaagagttcagaggagggagaaaaatcgtattgccgcccagaagagccgacagaggcagacacagaaggccgacaccctgcacctggaatttctccaaggaaatcactgaacagagacaaaacccagtgtgcatcacgatgttcatctcagcattatttttaatagtgacaatttgatagcaaccaagatgtccagcattagaagaccactttaagtaaattgtggataatcaatttgatgatgcagtcattaaaaattatgttgactatgtagatgtgacaaagttatgacagaaagcaaaatacaaattgtatgtgtactatgattgaaattttgtaaaaataagtat

SEQ ID NO: 1836 - DNA, 280 bp, synthetic construct
  misc_feature 1..280: note = Synthetic polypeptide
  source 1..280: mol_type = other DNA
atggccaccatggtaccatccgtgttgtggcccagggcctgctggactctgctggtctgctgtctgctgaccccaggatcacctgtccctttcacttgctaactcctacttagccttcagtttcgggctgcaatggtccccgcttccaggaagccttccctgactcacctcctcctatgctggatcagagcctcttctggcctccttctgagttctccccggtctctgatggattctacctttcccactggaccatgaaggcaggaacccttctgtctcg

SEQ ID NO: 1837 - DNA, 1102 bp, synthetic construct
  misc_feature 1..1102: note = Synthetic polypeptide
  source 1..1102: mol_type = other DNA
atggctttggtcacggtccagcggtcacctacccccagcaccacctccagcccctgcgcctcggaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtgggttgacagggattcaaggaacaaacactgtgatgtactattggtggaagaatgaactggagcagcctttctggagagtgatttgccaatatgccttatcattttgcatgatctttgtcctagtaactctatttctatggatttactctaagtttgtaaacatggatgtgtgcaaagattttagctctaagaatgtttgtcagtgttctaataatagcaaaaaataaaaaacaaatgattgaaaaatagaattagtaaattatggtacatctatatcattaaatattatgcaaccattaaaaatgatccagttgaaaaatatttgacatggaaagatgttgatgataggctgtaaagcaaaagagcaagttatagatgatatggagaatatggtcatatctttgtttattatacatctatgcatagccaaaaagactggaaagatctacgctaaaatcttaacagtggttatttcagggtggtaggattacaagatatttctgccttttctgtgaggtccctaattttctaaagtaggcatggatcacttttgctatgagggaaacaaa

SEQ ID NO: 1838 - DNA, 1183 bp, synthetic construct
  misc_feature 1..1183: note = Synthetic polypeptide
  source 1..1183: mol_type = other DNA
atggctttggtcacggtccagcggtcacctacccccagcaccacctccagcccctgcgcctcgagctctcatttggaagacagtgaatcagcagcattactttgctgtgaatgtgaagaatcagaaatctttactgattccaatgaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtgggttgacagggattcaaggaacaaacactgtgatgtactattggtggaagaatgaactggagcagcctttctggagagtgatttgccaatatgccttatcattttgcatgatctttgtcctagtaactctatttctatggatttactctaagtttgtaaacatggatgtgtgcaaagattttagctctaagaatgtttgtcagtgttctaataatagcaaaaaataaaaaacaaatgattgaaaaatagaattagtaaattatggtacatctatatcattaaatattatgcaaccattaaaaatgatccagttgaaaaatatttgacatggaaagatgttgatgataggctgtaaagcaaaagagcaagttatagatgatatggagaatatggtcatatctttgtttattatacatctatgcatagccaaaaagactggaaagatctacgctaaaatcttaacagtggttatttcagggtggtaggattacaagatatttctgccttttctgtgaggtccctaattttctaaagtaggcatggatcacttttgctatgagggaaacaaa

SEQ ID NO: 1839 - DNA, 603 bp, synthetic construct; identical to SEQ ID NO: 1012
  misc_feature 1..603: note = Synthetic polypeptide
  source 1..603: mol_type = other DNA

SEQ ID NO: 1840 - DNA, 1858 bp, synthetic construct
  misc_feature 1..1858: note = Synthetic polypeptide
  source 1..1858: mol_type = other DNA
atggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagggacacagttgtgcagaaatggagccagctctgggaggtggcgagtgtccctttgcaggtgtgtgagtagaggccatgggacggacaccttggaggggttgcagtttggaggatttggtgattggaagaagggattgggct

SEQ ID NO: 1841 - DNA, 2017 bp, synthetic construct
  misc_feature 1..2017: note = Synthetic polypeptide
  source 1..2017: mol_type = other DNA
atggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagggacacagttgtgcagaaatggagccagctctgggaggtggcgagtgtccctttgcaggtgtgtgagtagaggccatgggacggacaccttggaggggttgcagtttggaggatttggtgattggaagaagggattgggct

SEQ ID NO: 1842 - DNA, 1825 bp, synthetic construct
  misc_feature 1..1825: note = Synthetic polypeptide
  source 1..1825: mol_type = other DNA
atggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaagccggaatacacctggcgtctaccctgtggaggggttcgaaatccaaatcagagctcccaagtgatggaccctcccacagccaggcctacagaaccagggacacagttgtgcagaaatggagccagctctgggaggtggcgagtgtccctttgcaggtgtgtgagtagaggccatgggacggacaccttggaggggttgcagtttggaggatttggtgattggaagaagggattgggct

SEQ ID NO: 1843 - DNA, 2557 bp, synthetic construct; identical to SEQ ID NO: 1524
  misc_feature 1..2557: note = Synthetic polypeptide
  source 1..2557: mol_type = other DNA

SEQ ID NO: 1844 - DNA, 2428 bp, synthetic construct; identical to SEQ ID NO: 1525
  misc_feature 1..2428: note = Synthetic polypeptide
  source 1..2428: mol_type = other DNA

SEQ ID NO: 1845 - DNA, 669 bp, synthetic construct
  misc_feature 1..669: note = Synthetic polypeptide
  source 1..669: mol_type = other DNA
atgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaaggtaaaccagctatctatctatctc

SEQ ID NO: 1846 - DNA, 742 bp, synthetic construct
  misc_feature 1..742: note = Synthetic polypeptide
  source 1..742: mol_type = other DNA
atggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctctgccctgacgtcaggcctcaggtgcagagctgcactgcgtggtagcacaagccctgagttaacaagagaaataccggctttctggccagaggaatgaagaaaaagggcccctgcgggcaggaatgtgtaggggaatctccaaactgagagtacaggcggaaattccctaattctgagtctgaaccctcaggagtaccaggttacccctgagctgcacatgcgtgtgacatgccttaagggcacagcaaagactttgagaactgaatgaagattaga

SEQ ID NO: 1847 - DNA, 811 bp, synthetic construct
  misc_feature 1..811: note = Synthetic polypeptide
  source 1..811: mol_type = other DNA
atgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctctgccctgacgtcaggcctcaggtgcagagctgcactgcgtggtagcacaagccctgagttaacaagagaaataccggctttctggccagaggaatgaagaaaaagggcccctgcgggcaggaatgtgtaggggaatctccaaactgagagtacaggcggaaattccctaattctgagtctgaaccctcaggagtaccaggttacccctgagctgcacatgcgtgtgacatgccttaagggcacagcaaagactttgagaactgaatgaagattaga

SEQ ID NO: 1848 - DNA, 679 bp, synthetic construct
  misc_feature 1..679: note = Synthetic polypeptide
  source 1..679: mol_type = other DNA
atgctgcgggcgggagcaccaaccggggacttaccccgggcgggagaagtccacaccgggaccaccatcatggcagtggagtttgacgggggcgttgtgatgggttctgattcccgagtgtctgcagggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctctgccctgacgtcaggcctcaggtgcagagctgcactgcgtggtagcacaagccctgagttaacaagagaaataccggctttctggccagaggaatgaagaaaaagggcccctgcgggcaggaatgtgtaggggaatctccaaactgagagtacaggcggaaattccctaattctgagtctgaaccctcaggagtaccaggttacccctgagctgcacatgcgtgtgacatgccttaagggcacagcaaagactttgagaactgaatgaagattaga

SEQ ID NO: 1849 - DNA, 1204 bp, synthetic construct
  misc_feature 1..1204: note = Synthetic polypeptide
  source 1..1204: mol_type = other DNA
atggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagaatgtgtgtttcatgacagggcttcttgtctgctttgttcattgctacatctccagtacctgaaatagtacct

SEQ ID NO: 1850 - DNA, 1213 bp, synthetic construct
  misc_feature 1..1213: note = Synthetic polypeptide
  source 1..1213: mol_type = other DNA
atggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaggtgaaagagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagaatgtgtgtttcatgacagggcttcttgtctgctttgttcattgctacatctccagtacctgaaatagtacct

SEQ ID NO: 1851 - DNA, 650 bp, synthetic construct
  misc_feature 1..650: note = Synthetic polypeptide
  source 1..650: mol_type = other DNA
gggaagcccagtggaggacaatgagaaggatctggtgaaactggctaaacgcctcaagaaggagaaagtaaatgttgacattatcaattttggggaagaggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagaatgtgtgtttcatgacagggcttcttgtctgctttgttcattgctacatctccagtacctgaaatagtacct

SEQ ID NO: 1852 - DNA, 324 bp, synthetic construct
  misc_feature 1..324: note = Synthetic polypeptide
  source 1..324: mol_type = other DNA
acattgatgccagctcagctatggacacatctgagccagccaagagctcaattaacagagttctcagcaggcccctctatttggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagaatgtgtgtttcatgacagggcttcttgtctgctttgttcattgctacatctccagtacctgaaatagtacct

SEQ ID NO: 1853 - DNA, 1081 bp, synthetic construct; identical to SEQ ID NO: 986
  misc_feature 1..1081: note = Synthetic polypeptide
  source 1..1081: mol_type = other DNA

SEQ ID NO: 1854 - DNA, 1054 bp, synthetic construct; identical to SEQ ID NO: 987
  misc_feature 1..1054: note = Synthetic polypeptide
  source 1..1054: mol_type = other DNA

SEQ ID NO: 1855 - DNA, 348 bp, synthetic construct
  misc_feature 1..348: note = Synthetic polypeptide
  source 1..348: mol_type = other DNA
atgaagtgtctcgggaagcgcaggggccaggcagctgctttcctgcctctttgctggctctttttgaagattctgcaaccggggcacagccacctttataacaaccgctatgctggtgataaagtgataagatttattcccaaaacagaagaggaagcatatgcactgaagaaaatatcctatcaacttaagcctggataacagtaaaaacaggacccaagaagatgaaagagccagacatggaaaatttctggatcctcaaatcactccatagaggaaagctgcccactcacaagaaataaccacctttgtctgttatgtgaccaagaaataaatgtctcttatatt

SEQ ID NO: 1856 - DNA, 1022 bp, synthetic construct
  misc_feature 1..1022: note = Synthetic polypeptide
  source 1..1022: mol_type = other DNA
gggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccaggctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccctgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcaggtttcctgtctgtgcgatggggatggaggtgatagtgtctaccctcctgaggtcgttggggggactaaatgggatagtaagtgtaaatgggacagcagtgccaggcacagagtgagcacttcaataagt

SEQ ID NO: 1857 - DNA, 619 bp, synthetic construct
  misc_feature 1..619: note = Synthetic polypeptide
  source 1..619: mol_type = other DNA
atgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccctgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcaggtttcctgtctgtgcgatggggatggaggtgatagtgtctaccctcctgaggtcgttggggggactaaatgggatagtaagtgtaaatgggacagcagtgccaggcacagagtgagcacttcaataagt

SEQ ID NO: 1858 - DNA, 346 bp, synthetic construct
  misc_feature 1..346: note = Synthetic polypeptide
  source 1..346: mol_type = other DNA
atggcgtcttctatgacctggacagctgcaagcattccagctaccctgattcagagggggctcctgaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcaggtttcctgtctgtgcgatggggatggaggtgatagtgtctaccctcctgaggtcgttggggggactaaatgggatagtaagtgtaaatgggacagcagtgccaggcacagagtgagcacttcaataagt

SEQ ID NO: 1859 - DNA, 757 bp, synthetic construct
  misc_feature 1..757: note = Synthetic polypeptide
  source 1..757: mol_type = other DNA
atgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagctcaggatttggcacacagaagctcaatgtgtatttgttgaat

SEQ ID NO: 1860 - DNA, 817 bp, synthetic construct
  misc_feature 1..817: note = Synthetic polypeptide
  source 1..817: mol_type = other DNA
atgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagctcaggatttggcacacagaagctcaatgtgtatttgttgaat

SEQ ID NO: 1861 - DNA, 767 bp, synthetic construct; identical to SEQ ID NO: 937
  misc_feature 1..767: note = Synthetic polypeptide
  source 1..767: mol_type = other DNA

SEQ ID NO: 1862 - DNA, 677 bp, synthetic construct; identical to SEQ ID NO: 938
  misc_feature 1..677: note = Synthetic polypeptide
  source 1..677: mol_type = other DNA

SEQ ID NO: 1863 - DNA, 464 bp, synthetic construct
  misc_feature 1..464: note = Synthetic polypeptide
  source 1..464: mol_type = other DNA
atgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgaacctgggtcgtgtgtaacatgcatgtttgttccctagcctgcatcaggaccaccttcatgaatatccatagctcctgttgaatatgtatgtttagctaactcattcatcatatatcttctaccccaatcccttctccttcaaagtgcctgtctttggtgtagccctcccagcttgccagatggccaccttgcaggttgtaaccctttataagaaataaagtctccttttccaaatttatagatcttgtgattttt

SEQ ID NO: 1864 - DNA, 980 bp, synthetic construct; identical to SEQ ID NO: 139
  misc_feature 1..980: note = Synthetic polypeptide
  source 1..980: mol_type = other DNA

SEQ ID NO: 1865 - DNA, 1256 bp, synthetic construct; identical to SEQ ID NO: 140
  misc_feature 1..1256: note = Synthetic polypeptide
  source 1..1256: mol_type = other DNA

SEQ ID NO: 1866 - DNA, 1277 bp, synthetic construct; identical to SEQ ID NO: 142
  misc_feature 1..1277: note = Synthetic polypeptide
  source 1..1277: mol_type = other DNA

SEQ ID NO: 1867 - DNA, 287 bp, synthetic construct
  misc_feature 1..287: note = Synthetic polypeptide
  source 1..287: mol_type = other DNA
atggaggactttgctaccaggacctacggcaccagtggcctggacaacagacctctgtttggggagacgtccgccaaggcttcagttacctgtggtcagccatggtccaaaaatattaaatggaaaacttcagaaataatttgtaagttttaaactgtgcactgttctatgtaatatgattaactctcactctgtcctgctcctgctggggatgtgaatcatccctttgtccagtagatgctacctgcctgttagtcacttagtagccatctctgttatctgattga

SEQ ID NO: 1868 - DNA, 338 bp, synthetic construct
  misc_feature 1..338: note = Synthetic polypeptide
  source 1..338: mol_type = other DNA
atggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagggcatgacgaagctttgttcatctctgtacctccagctgccagctcaatgcctagcatattgtggacattcaatatatat

SEQ ID NO: 1869 - DNA, 344 bp, synthetic construct
  misc_feature 1..344: note = Synthetic polypeptide
  source 1..344: mol_type = other DNA
atgacagaggggaccaagaagaccagcaaaaagttcagtgcagtggtggctcacgcctgtaatcccagcactttgggaggccgaggctggtggatcacctgaggtcaggagttcgagaccagcctggccaacatggtgaaacccctctctactaaaaatacaaaaaattagctgggtatggtgacacgcacctgtaatcccagctactcaggaggctgaggcagaagaaacgcttgaacccaggaggtggagatagcagtgagcagagattgcaccactgcactccagtctgggcgacacagcgagactgcatctcaaaaaataagtaaataaataaagtaaaa

SEQ ID NO: 1870 - DNA, 617 bp, synthetic construct
  misc_feature 1..617: note = Synthetic polypeptide
  source 1..617: mol_type = other DNA
atgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggtgctgtggcacatacccctagactcagctacttaggagactgaagcaagaggattgcttgagcccaggagtccagactgggcaacataacgagaccccatctc

SEQ ID NO: 1871 - DNA, 502 bp, synthetic construct
  misc_feature 1..502: note = Synthetic polypeptide
  source 1..502: mol_type = other DNA
aactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggtgctgtggcacatacccctagactcagctacttaggagactgaagcaagaggattgcttgagcccaggagtccagactgggcaacataacgagaccccatctc

SEQ ID NO: 1872 - DNA, 649 bp, synthetic construct
  misc_feature 1..649: note = Synthetic polypeptide
  source 1..649: mol_type = other DNA
atgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacagaaattcaatatcgtttgcctgaaaataa

SEQ ID NO: 1873 - DNA, 559 bp, synthetic construct
  misc_feature 1..559: note = Synthetic polypeptide
  source 1..559: mol_type = other DNA
atgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggccggcggaggagagcccggcttcgtttcatgaaacagaaattcaatatcgtttgcctgaaaataa

SEQ ID NO: 1874 - DNA, 109 bp, synthetic construct
  misc_feature 1..109: note = Synthetic polypeptide
  source 1..109: mol_type = other DNA
atgcggccgcggctgtggctcctcttggccgcgcagctgacaggccggcggaggagagcccggcttcgtttcatgaaacagaaattcaatatcgtttgcctgaaaataa

SEQ ID NO: 1875 - DNA, 509 bp, synthetic construct
  misc_feature 1..509: note = Synthetic polypeptide
  source 1..509: mol_type = other DNA
atgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggcgtgttggctcacacctgtaatcctaacactttgggaggccgaggtgagtggatcacttgagatcaggagttcgagaccagcctggccaacatggtgaaacaccgtctctactaaaagtacaaaaaaattagctgggtatggtagcaggcgcctgtaatcccagctacttgggaggctgagacacaagaatcgcttgaacctgggaggccggaggttgcagtgagccaaggtcacgccactatactccagctggtcaagagtgagactttgtctcgaaataaa

SEQ ID NO: 1876 - DNA, 722 bp, synthetic construct; identical to SEQ ID NO: 1598
  misc_feature 1..722: note = Synthetic polypeptide
  source 1..722: mol_type = other DNA

SEQ ID NO: 1877 - DNA, 866 bp, synthetic construct; identical to SEQ ID NO: 1599
  misc_feature 1..866: note = Synthetic polypeptide
  source 1..866: mol_type = other DNA

SEQ ID NO: 1878 - DNA, 740 bp, synthetic construct; identical to SEQ ID NO: 1600
  misc_feature 1..740: note = Synthetic polypeptide
  source 1..740: mol_type = other DNA

SEQ ID NO: 1879 - DNA, 150 bp, synthetic construct
  misc_feature 1..150: note = Synthetic polypeptide
  source 1..150: mol_type = other DNA
atgcctggtccgacccccagtggcactaacgtgggatcctcagggcgctctcccagcaaagcagtggccgcccgggcggcgggatccactgtccggcagaggtacccaccataaggcatgacacaataaataatgactgaaggaaggaat

SEQ ID NO: 1880 - DNA, 562 bp, synthetic construct
  misc_feature 1..562: note = Synthetic polypeptide
  source 1..562: mol_type = other DNA
caagtcgcctacgtgcgcgcccgggagctgcacactcttgaagtgaccggcctggagacggttgcccagagcaaggcccatgtagcatccctggagggcctcatccctgaagataaggttgtgcttctggcaggttctcccttacagaatgaagccaccctgggtcagtgtggggtggaagccctgacaaccctggaagtggttggccgcaggctaggagatggtgagtttataaaagactgtctattgagtgcagcggaaatcatgtgtcctgaacagaaagaagcatttgcagacataagcctaaccagaaaaactgttgctcagagagtaaaagatatggctgagaatttacaggataagttgtgagaaaaagtgagatcatttgtgacattttctattgcagttgatgagtgcacatatgtaaataatacaagtcagttaattatgtttatccatggtgttgctgagaattttgatatcattgaagaacttttagacatggtacctatggcagatccaaccactgaaagtgacttatttttgtatgttgaaaaaagtc

SEQ ID NO: 1881 - DNA, 207 bp, synthetic construct
  misc_feature 1..207: note = Synthetic polypeptide
  source 1..207: mol_type = other DNA
atggccaccatggtaccatccgtgttgtggcccagggcctgctggactctgctggtctgctgtctgctgaccccaggaagccttccctgactcacctcctcctatgctggatcagagcctcttctggcctccttctgagttctccccggtctctgatggattctacctttcccactggaccatgaaggcaggaacccttctgtctcg

SEQ ID NO: 1882 - DNA, 1310 bp, synthetic construct
  misc_feature 1..1310: note = Synthetic polypeptide
  source 1..1310: mol_type = other DNA
atggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagggaggcagaggaagctaccgaagaggaagcaggacgagtgatggtgaagcaggaggctggagtggtgggagaagaggctacgaggcagggaaggcaggccctctctggaagctggaaaagcaaggaaacggattcccccgcctgatcttcgggaaggagccagccctgcggacaacctccacgttagtctagtgaaactgattccacacatctggcctccggagctgtaatataataaatctgtgttgttttaagtaatgtgttacagcagcaataagaaa

SEQ ID NO: 1883 - DNA, 395 bp, synthetic construct
  misc_feature 1..395: note = Synthetic polypeptide
  source 1..395: mol_type = other DNA
atggagagacctataaaggactccatgttttcgttggccctgaaatgccttatcagtctgtccaccatcatccttttgggcttgatcatcgcctaccacacacgtgaagtccagggaggcagaggaagctaccgaagaggaagcaggacgagtgatggtgaagcaggaggctggagtggtgggagaagaggctacgaggcagggaaggcaggccctctctggaagctggaaaagcaaggaaacggattcccccgcctgatcttcgggaaggagccagccctgcggacaacctccacgttagtctagtgaaactgattccacacatctggcctccggagctgtaatataataaatctgtgttgttttaagtaatgtgttacagcagcaataagaaa

SEQ ID NO: 1884 - DNA, 371 bp, synthetic construct
  misc_feature 1..371: note = Synthetic polypeptide
  source 1..371: mol_type = other DNA
atgttttcgttggccctgaaatgccttatcagtctgtccaccatcatccttttgggcttgatcatcgcctaccacacacgtgaagtccagggaggcagaggaagctaccgaagaggaagcaggacgagtgatggtgaagcaggaggctggagtggtgggagaagaggctacgaggcagggaaggcaggccctctctggaagctggaaaagcaaggaaacggattcccccgcctgatcttcgggaaggagccagccctgcggacaacctccacgttagtctagtgaaactgattccacacatctggcctccggagctgtaatataataaatctgtgttgttttaagtaatgtgttacagcagcaataagaaa

SEQ ID NO: 1885 - DNA, 161 bp, synthetic construct
  misc_feature 1..161: note = Synthetic polypeptide
  source 1..161: mol_type = other DNA
atgctgctgtgggtgatattactggtcctggctcctgtcagtggacagtttgctgtgatgggattcttctgggcacttgaatcatcatctacaaaatgaagatattaggtaagttgagctctcaaggttttctcagggacaaatcttaagataatatgatt

SEQ ID NO: 1886 - DNA, 177 bp, synthetic construct
  misc_feature 1..177: note = Synthetic polypeptide
  source 1..177: mol_type = other DNA
atggctactcatcacacactgtggatgggactggccctgctgggggtgctgggcgacctgcaggcagcaccggaggcccaggtctccgtgcagcccaacttccagcaggacaagttcctggggcggggcgtgaggggcgtggctgctcgggggattgggcgtgggggcggggccggg

SEQ ID NO: 1887 - DNA, 258 bp, synthetic construct
  misc_feature 1..258: note = Synthetic polypeptide
  source 1..258: mol_type = other DNA
atggctgcaagtggccgaggtctctgcaaggctgtggccgcctctcccttcccggcgtggagacgagataacacggaagccaggggaggtctgaagcctgagtatgatgcggtggtgataggagcaggcaggcacctgggattccggtgctggctctgctgtgtggcctggggcaaatgcttgccttctctgggcttggatcttcccatggagaatgacaggaagactaggtgagctcaggggtttccctatatctct

SEQ ID NO: 1888 - DNA, 906 bp, synthetic construct
  misc_feature 1..906: note = Synthetic polypeptide
  source 1..906: mol_type = other DNA
atggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaagatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacgacagagatgctcaatatttgttgaagcaatgaa

SEQ ID NO: 1889 - DNA, 1077 bp, synthetic construct
  misc_feature 1..1077: note = Synthetic polypeptide
  source 1..1077: mol_type = other DNA
atggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaaacaaataaacctcagagatcacgacccaatctcatcaaaccagctgcccagtggcaagatctgaaaaggttgggagaagaaaggcctaaaaagtctagagcagcatttgaatcagataagagcagctatttttcagtgtgtaacaacccattgtttgattctggggcacaggatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacgacagagatgctcaatatttgttgaagcaatgaa

SEQ ID NO: 1890 - DNA, 1809 bp, synthetic construct
  misc_feature 1..1809: note = Synthetic polypeptide
  source 1..1809: mol_type = other DNA
atggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtgacagagcaagaccctgtctcaaaacaaaa

SEQ ID NO: 1891 - DNA, 1812 bp, synthetic construct
  misc_feature 1..1812: note = Synthetic polypeptide
  source 1..1812: mol_type = other DNA
atggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtgacagagcaagaccctgtctcaaaacaaaa

SEQ ID NO: 1892 - DNA, 1875 bp, synthetic construct
  misc_feature 1..1875: note = Synthetic polypeptide
  source 1..1875: mol_type = other DNA
atggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatggctcttggacaagtccgagcagtacaacacactgggagggaatgccctctccttttaaagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtgacagagcaagaccctgtctcaaaacaaaa

SEQ ID NO: 1893 - DNA, 504 bp, synthetic construct
  misc_feature 1..504: note = Synthetic polypeptide
  source 1..504: mol_type = other DNA
atggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcaagactccgtctcaaaaacaaccctaaaaccaaaaaacaaa

SEQ ID NO: 1894 - DNA, 801 bp, synthetic construct
  misc_feature 1..801: note = Synthetic polypeptide
  source 1..801: mol_type = other DNA
atggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcaagactccgtctcaaaaacaaccctaaaaccaaaaaacaaa

SEQ ID NO: 1895 - DNA, 438 bp, synthetic construct
  misc_feature 1..438: note = Synthetic polypeptide
  source 1..438: mol_type = other DNA
atgctttccccttgtctctcgtcttattttgtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcaagactccgtctcaaaaacaaccctaaaaccaaaaaacaaa

SEQ ID NO: 1896 - DNA, 145 bp, synthetic construct
  misc_feature 1..145: note = Synthetic polypeptide
  source 1..145: mol_type = other DNA
ggcttctttgctaaagaatgatgagactaaggccctcactccagcttccttgcagaaggaattaaacaatttgttgaaatttaatcctgattttgctgaagcgcaagactccgtctcaaaaacaaccctaaaaccaaaaaacaaa

SEQ ID NO: 1897 - DNA, 378 bp, synthetic construct
  misc_feature 1..378: note = Synthetic polypeptide
  source 1..378: mol_type = other DNA
atggcccgggagaggccgcccgggaggggctgcggcgtcctgcgccggtgtctactcggggctgtgctgttgttcggcctgcggctctgcgcagagctgcggcgcgccgggcccgggtagatcttcctggagtcaggttgcttgggaatgcagcccagtgcagttaattggtggtaaactccaattaaagctaaagaccggcacaagaccaatagtcaaccagtgccacaagagaaagttggaaagaactttgaagagagagttcaagagggcgtgaaaccttaagggtaaacaggtgggatctgtgcagccttccagaggattgaactgggcagcgagtctggccctgatgacagtcctgcagatctttcctgctcc

SEQ ID NO: 1898 - DNA, 1230 bp, synthetic construct
  misc_feature 1..1230: note = Synthetic polypeptide
  source 1..1230: mol_type = other DNA
atgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgt

SEQ ID NO: 1899 - DNA, 456 bp, synthetic construct
  misc_feature 1..456: note = Synthetic polypeptide
  source 1..456: mol_type = other DNA
atgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgt

SEQ ID NO: 1900 - DNA, 1134 bp, synthetic construct
  misc_feature 1..1134: note = Synthetic polypeptide
  source 1..1134: mol_type = other DNA
atgaggaggcctggggaccatgggctccaggatcaagaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgt

SEQ ID NO: 1901 - DNA, 1140 bp, synthetic construct
  misc_feature 1..1140: note = Synthetic polypeptide
  source 1..1140: mol_type = other DNA
atgttgaagtggcctatcccaggacaggtggcactctttcaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgt

SEQ ID NO: 1902 - DNA, 1134 bp, synthetic construct
  misc_feature 1..1134: note = Synthetic polypeptide
  source 1..1134: mol_type = other DNA
atgttgaagtggcctatcccaggacaggtggcactctttcagatcctgaggtgcagaggcaattcccggaggactacagtgaccagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgt

SEQ ID NO: 1903 - DNA, 277 bp, synthetic construct
  misc_feature 1..277: note = Synthetic polypeptide
  source 1..277: mol_type = other DNA
atgatgagaatagaggtaaaggtgaaaatgatgctttgatgcctgaaggtacaacaaacatctcatgactatgaggggatgaaaatggataccaaggataccaagatgatggaacaaaaagaattgatttggaacatgacggcactatggattcatcgtattggacctctgtgatataattctgaacttttcatataagactaatatacccctacttgtttaatacaactgtagagttatctgctacttgcagccaaatgtaatcctaactaatata

SEQ ID NO: 1904 - DNA, 1307 bp, synthetic construct
  misc_feature 1..1307: note = Synthetic polypeptide
  source 1..1307: mol_type = other DNA
atgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagttggctgggcatggtcatgcactcctgtggtcctagctacttcaggaggctgaagtggatcacttgagcccaggaggttgaggctgcagggagctgtgttcgcatcactgcatcccacctggagatagagtaagaccctgtctcaaaaataaaaattaaaaacaacaaa

SEQ ID NO: 1905 - DNA, 1421 bp, synthetic construct
  misc_feature 1..1421: note = Synthetic polypeptide
  source 1..1421: mol_type = other DNA
atgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtaaggcccctcctggcagcagagctcagtctggtgagaaacccgccccctcccacctcctgcatgtgtctcttgcctctgccctgggctgcacaggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagttggctgggcatggtcatgcactcctgtggtcctagctacttcaggaggctgaagtggatcacttgagcccaggaggttgaggctgcagggagctgtgttcgcatcactgcatcccacctggagatagagtaagaccctgtctcaaaaataaaaattaaaaacaacaaa

SEQ ID NO: 1906 - DNA, 1325 bp, synthetic construct
  misc_feature 1..1325: note = Synthetic polypeptide
  source 1..1325: mol_type = other DNA
atgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagttggctgggcatggtcatgcactcctgtggtcctagctacttcaggaggctgaagtggatcacttgagcccaggaggttgaggctgcagggagctgtgttcgcatcactgcatcccacctggagatagagtaagaccctgtctcaaaaataaaaattaaaaacaacaaa

SEQ ID NO: 1907 - DNA, 1403 bp, synthetic construct
  misc_feature 1..1403: note = Synthetic polypeptide
  source 1..1403: mol_type = other DNA
atgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtaaggcccctcctggcagcagagctcagtctggtgagaaacccgccccctcccacctcctgcatgtgtctcttgcctctgccctgggctgcacaggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagttggctgggcatggtcatgcactcctgtggtcctagctacttcaggaggctgaagtggatcacttgagcccaggaggttgaggctgcagggagctgtgttcgcatcactgcatcccacctggagatagagtaagaccctgtctcaaaaataaaaattaaaaacaacaaa

SEQ ID NO: 1908 - DNA, 539 bp, synthetic construct
  misc_feature 1..539: note = Synthetic polypeptide
  source 1..539: mol_type = other DNA
atggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagttggctgggcatggtcatgcactcctgtggtcctagctacttcaggaggctgaagtggatcacttgagcccaggaggttgaggctgcagggagctgtgttcgcatcactgcatcccacctggagatagagtaagaccctgtctcaaaaataaaaattaaaaacaacaaa

SEQ ID NO: 1909 - DNA, 1262 bp, synthetic construct
  misc_feature 1..1262: note = Synthetic polypeptide
  source 1..1262: mol_type = other DNA
atgcataggtcctttctacaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagttggctgggcatggtcatgcactcctgtggtcctagctacttcaggaggctgaagtggatcacttgagcccaggaggttgaggctgcagggagctgtgttcgcatcactgcatcccacctggagatagagtaagaccctgtctcaaaaataaaaattaaaaacaacaaa

SEQ ID NO: 1910 - DNA, 1052 bp, synthetic construct; identical to SEQ ID NO: 247
  misc_feature 1..1052: note = Synthetic polypeptide
  source 1..1052: mol_type = other DNA

SEQ ID NO: 1911 - DNA, 327 bp, synthetic construct; identical to SEQ ID NO: 246
  misc_feature 1..327: note = Synthetic polypeptide
  source 1..327: mol_type = other DNA

SEQ ID NO: 1912 - DNA, 3308 bp, synthetic construct; identical to SEQ ID NO: 428
  misc_feature 1..3308: note = Synthetic polypeptide
  source 1..3308: mol_type = other DNA

SEQ ID NO: 1913 - DNA, 3203 bp, synthetic construct; identical to SEQ ID NO: 429
  misc_feature 1..3203: note = Synthetic polypeptide
  source 1..3203: mol_type = other DNA

SEQ ID NO: 1914 - DNA, 2849 bp, synthetic construct; identical to SEQ ID NO: 430
  misc_feature 1..2849: note = Synthetic polypeptide
  source 1..2849: mol_type = other DNA

SEQ ID NO: 1915 - DNA, 388 bp, synthetic construct; identical to SEQ ID NO: 431
  misc_feature 1..388: note = Synthetic polypeptide
  source 1..388: mol_type = other DNA

SEQ ID NO: 1916 - DNA, 361 bp, synthetic construct
  misc_feature 1..361: note = Synthetic polypeptide
  source 1..361: mol_type = other DNA
atgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagcctagcacaaaactagaagcaacccaagcacctgtcactggagactaattatgcggcacccatacagggaccctctgcggccatcatggagagccttcatcttgcccgtacagttttaagcgaaaaaggaagtatacaacaaagtccatagtatgctatgattcattttgtgtcttaagaaagga

SEQ ID NO: 1917 - DNA, 95 bp, synthetic construct
  misc_feature 1..95: note = Synthetic polypeptide
  source 1..95: mol_type = other DNA
atggcagaggttgcagtgagctgagatcgtgcggctgcactccaccttgggcgacagagcgagactccatctcaagaaaaaagaaagaaagaaaa

SEQ ID NO: 1918 - DNA, 1743 bp, synthetic construct; identical to SEQ ID NO: 1253
  misc_feature 1..1743: note = Synthetic polypeptide
  source 1..1743: mol_type = other DNA

SEQ ID NO: 1919 - DNA, 1518 bp, synthetic construct; identical to SEQ ID NO: 1254
  misc_feature 1..1518: note = Synthetic polypeptide
  source 1..1518: mol_type = other DNA

SEQ ID NO: 1920 - DNA, 1767 bp, synthetic construct; identical to SEQ ID NO: 1255
  misc_feature 1..1767: note = Synthetic polypeptide
  source 1..1767: mol_type = other DNA

SEQ ID NO: 1921 - DNA, 1390 bp, synthetic construct
  misc_feature 1..1390: note = Synthetic polypeptide
  source 1..1390: mol_type = other DNA
atgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggtacatggatgaagctggaacccatcatcctcagcaaagtaacacaggaacagaaaaccaaacaccgcatgttctcactcataagtgggagttgatcattgagaacacatggacacagagaggggaacaacacacaccagggcctgttggggtgtgggtggtgaggggagggaacttagaggatgggtcaataggtgcagcaagccaccatggcacatgcatacctatgtaagaaacctgcatgttctgcacgtgtgtccc

SEQ ID NO: 1922 - DNA, 1384 bp, synthetic construct
  misc_feature 1..1384: note = Synthetic polypeptide
  source 1..1384: mol_type = other DNA
atgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggtacatggatgaagctggaacccatcatcctcagcaaagtaacacaggaacagaaaaccaaacaccgcatgttctcactcataagtgggagttgatcattgagaacacatggacacagagaggggaacaacacacaccagggcctgttggggtgtgggtggtgaggggagggaacttagaggatgggtcaataggtgcagcaagccaccatggcacatgcatacctatgtaagaaacctgcatgttctgcacgtgtgtccc

SEQ ID NO: 1923 - DNA, 1408 bp, synthetic construct
  misc_feature 1..1408: note = Synthetic polypeptide
  source 1..1408: mol_type = other DNA
atggggaggggcttcaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggtacatggatgaagctggaacccatcatcctcagcaaagtaacacaggaacagaaaaccaaacaccgcatgttctcactcataagtgggagttgatcattgagaacacatggacacagagaggggaacaacacacaccagggcctgttggggtgtgggtggtgaggggagggaacttagaggatgggtcaataggtgcagcaagccaccatggcacatgcatacctatgtaagaaacctgcatgttctgcacgtgtgtccc

SEQ ID NO: 1924 - DNA, 496 bp, synthetic construct
  misc_feature 1..496: note = Synthetic polypeptide
  source 1..496: mol_type = other DNA
atgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagagatcattgatggcacttcagaaatgaatgaaggaaagaggtcccagaagacgcctagtacaccacgaagggtcacacaaggtacatggatgaagctggaacccatcatcctcagcaaagtaacacaggaacagaaaaccaaacaccgcatgttctcactcataagtgggagttgatcattgagaacacatggacacagagaggggaacaacacacaccagggcctgttggggtgtgggtggtgaggggagggaacttagaggatgggtcaataggtgcagcaagccaccatggcacatgcatacctatgtaagaaacctgcatgttctgcacgtgtgtccc

SEQ ID NO: 1925 - DNA, 2466 bp, synthetic construct; identical to SEQ ID NO: 1682
  misc_feature 1..2466: note = Synthetic polypeptide
  source 1..2466: mol_type = other DNA

SEQ ID NO: 1926 - DNA, 1146 bp, synthetic construct; identical to SEQ ID NO: 988
  misc_feature 1..1146: note = Synthetic polypeptide
  source 1..1146: mol_type = other DNA

SEQ ID NO: 1927 - DNA, 1273 bp, synthetic construct
  misc_feature 1..1273: note = Synthetic polypeptide
  source 1..1273: mol_type = other DNA
atgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgagaatccagaatttttctatttttcatctgtaatgtcaaggagaagagaattgacagaggaagacatttctgatgattaacaaatcagaagatgaacacaaaaagacagatagatggcagcactccagactgtaatgatgatggtgagattgtctaagcaaaatcgcagactgtgagtcttcagatgctagcatagatgaatttccccaaactcaagaatcagctagtgattatttatctgatgtatggaaaggaaatgtggtatattctcatctagtcattcaacagaaaggacttcatcatgcaacatttttcgacaagaacctctcccatcctgtttgcatttaaaaaaaaaaaagtacgtgtgacaacattcttttatcttttatgtttggccgccaacatttatttcttaccacttattgtcaacaaaataactggacaaatgcacaaggaggtgtgtgtccaaaggtgattggaagaaaatagatataaaaatgacaaaaataactggattgatccttctgttggtgtttataatccaaaaatgaaagcattttgcacttaatggagcaaggaaatggctgctttctcttcaacagaattatgagtctgtttcaaaagtagtgtgtttgacagtgccagtacacgaagaatctgaagtcctgttaagttagaacctgttggagatggacttggaatctgacatcgctacaggtgggctgtgccccagctgcaggtgcatcaggtgatgagcagttagttgcatatagaggaccttgctttttttcaggtatatatgccttccaaattagaaacattgggataagaagctgggtttgctgtgtttaagttcttattaaaatgtctaataaaatggcttttgtcatccttttatttggtaaattatttgtaaaatgactttagatatagaaaaacagaagagtctgttggagccagataataaatggtgatggctaattttcctagcatactgtgaggg

SEQ ID NO: 1928 - DNA, 1516 bp, synthetic construct
  misc_feature 1..1516: note = Synthetic polypeptide
  source 1..1516: mol_type = other DNA
atgtctcaagttcaagtgcaagttcagaacccatctgctgctctctcagggagccaaatactgaacaagaaccagtctcttctctcacagcctttgatgagtattccttctactactagctctctgccctctgaaaatgcaggtagacccattcaaaactctgctttaccctctgcatctattacatccaccagtgcagctgcagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgagaatccagaatttttctatttttcatctgtaatgtcaaggagaagagaattgacagaggaagacatttctgatgattaacaaatcagaagatgaacacaaaaagacagatagatggcagcactccagactgtaatgatgatggtgagattgtctaagcaaaatcgcagactgtgagtcttcagatgctagcatagatgaatttccccaaactcaagaatcagctagtgattatttatctgatgtatggaaaggaaatgtggtatattctcatctagtcattcaacagaaaggacttcatcatgcaacatttttcgacaagaacctctcccatcctgtttgcatttaaaaaaaaaaaagtacgtgtgacaacattcttttatcttttatgtttggccgccaacatttatttcttaccacttattgtcaacaaaataactggacaaatgcacaaggaggtgtgtgtccaaaggtgattggaagaaaatagatataaaaatgacaaaaataactggattgatccttctgttggtgtttataatccaaaaatgaaagcattttgcacttaatggagcaaggaaatggctgctttctcttcaacagaattatgagtctgtttcaaaagtagtgtgtttgacagtgccagtacacgaagaatctgaagtcctgttaagttagaacctgttggagatggacttggaatctgacatcgctacaggtgggctgtgccccagctgcaggtgcatcaggtgatgagcagttagttgcatatagaggaccttgctttttttcaggtatatatgccttccaaattagaaacattgggataagaagctgggtttgctgtgtttaagttcttattaaaatgtctaataaaatggcttttgtcatccttttatttggtaaattatttgtaaaatgactttagatatagaaaaacagaagagtctgttggagccagataataaatggtgatggctaattttcctagcatactgtgaggg

SEQ ID NO: 1929 - DNA, 1393 bp, synthetic construct
  misc_feature 1..1393: note = Synthetic polypeptide
  source 1..1393: mol_type = other DNA
atgtgtgaagtgtcaagggggtggaagccgtgcactgagggaatcctaaaagtaagacctacaagaaaaatcagctatgaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgagaatccagaatttttctatttttcatctgtaatgtcaaggagaagagaattgacagaggaagacatttctgatgattaacaaatcagaagatgaacacaaaaagacagatagatggcagcactccagactgtaatgatgatggtgagattgtctaagcaaaatcgcagactgtgagtcttcagatgctagcatagatgaatttccccaaactcaagaatcagctagtgattatttatctgatgtatggaaaggaaatgtggtatattctcatctagtcattcaacagaaaggacttcatcatgcaacatttttcgacaagaacctctcccatcctgtttgcatttaaaaaaaaaaaagtacgtgtgacaacattcttttatcttttatgtttggccgccaacatttatttcttaccacttattgtcaacaaaataactggacaaatgcacaaggaggtgtgtgtccaaaggtgattggaagaaaatagatataaaaatgacaaaaataactggattgatccttctgttggtgtttataatccaaaaatgaaagcattttgcacttaatggagcaaggaaatggctgctttctcttcaacagaattatgagtctgtttcaaaagtagtgtgtttgacagtgccagtacacgaagaatctgaagtcctgttaagttagaacctgttggagatggacttggaatctgacatcgctacaggtgggctgtgccccagctgcaggtgcatcaggtgatgagcagttagttgcatatagaggaccttgctttttttcaggtatatatgccttccaaattagaaacattgggataagaagctgggtttgctgtgtttaagttcttattaaaatgtctaataaaatggcttttgtcatccttttatttggtaaattatttgtaaaatgactttagatatagaaaaacagaagagtctgttggagccagataataaatggtgatggctaattttcctagcatactgtgaggg

SEQ ID NO: 1930 - DNA, 193 bp, synthetic construct; identical to SEQ ID NO: 975
  misc_feature 1..193: note = Synthetic polypeptide
  source 1..193: mol_type = other DNA

SEQ ID NO: 1931 - DNA, 822 bp, synthetic construct; identical to SEQ ID NO: 119
  misc_feature 1..822: note = Synthetic polypeptide
  source 1..822: mol_type = other DNA

SEQ ID NO: 1932 - DNA, 1673 bp, synthetic construct
  misc_feature 1..1673: note = Synthetic polypeptide
  source 1..1673: mol_type = other DNA
atgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactctccggcaagacctccaccgaggccgccgccaagacctccaccgaggccaccgccatagccactgccactgcc

SEQ ID NO: 1933 - DNA, 3881 bp, synthetic construct; identical to SEQ ID NO: 1162
  misc_feature 1..3881: note = Synthetic polypeptide
  source 1..3881: mol_type = other DNA

SEQ ID NO: 1934 - DNA, 3722 bp, synthetic construct; identical to SEQ ID NO: 1163
  misc_feature 1..3722: note = Synthetic polypeptide
  source 1..3722: mol_type = other DNA

SEQ ID NO: 1935 - DNA, 610 bp, synthetic construct; identical to SEQ ID NO: 163
  misc_feature 1..610: note = Synthetic polypeptide
  source 1..610: mol_type = other DNA

SEQ ID NO: 1936 - DNA, 412 bp, synthetic construct; identical to SEQ ID NO: 1704
  misc_feature 1..412: note = Synthetic polypeptide
  source 1..412: mol_type = other DNA

SEQ ID NO: 1937 - DNA, 840 bp, synthetic construct
  misc_feature 1..840: note = Synthetic polypeptide
  source 1..840: mol_type = other DNA
atgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggag

SEQ ID NO: 1938 - DNA, 385 bp, synthetic construct
  misc_feature 1..385: note = Synthetic polypeptide
  source 1..385: mol_type = other DNA
atgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagacgattacttgagcccaggaggcagaggttgcagtgagctgagatcttaccactgcattccagcaagactcagtctcaaaaaaaaaaaagaaaaaaaaaaaaagaaa

SEQ ID NO: 1939 - DNA, 840 bp, synthetic construct; identical to SEQ ID NO: 1937
  misc_feature 1..840: note = Synthetic polypeptide
  source 1..840: mol_type = other DNA

SEQ ID NO: 1940 - DNA, 487 bp, synthetic construct; identical to SEQ ID NO: 918
  misc_feature 1..487: note = Synthetic polypeptide
  source 1..487: mol_type = other DNA

SEQ ID NO: 1941 - DNA, 823 bp, synthetic construct
  misc_feature 1..823: note = Synthetic polypeptide
  source 1..823: mol_type = other DNA
atggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgaggcaggaggatcgcttgaacccaggaagtggagactgcagtgagccgatatcgcaccacagcgctccagcctggtcgacagagtgagactccatctcaagaaaaaataaaaataaa

SEQ ID NO: 1942 - DNA, 715 bp, synthetic construct
  misc_feature 1..715: note = Synthetic polypeptide
  source 1..715: mol_type = other DNA
atggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgaggcaggaggatcgcttgaacccaggaagtggagactgcagtgagccgatatcgcaccacagcgctccagcctggtcgacagagtgagactccatctcaagaaaaaataaaaataaa

SEQ ID NO: 1943 - DNA, 299 bp, synthetic construct
  misc_feature 1..299: note = Synthetic polypeptide
  source 1..299: mol_type = other DNA
gctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgaggcaggaggatcgcttgaacccaggaagtggagactgcagtgagccgatatcgcaccacagcgctccagcctggtcgacagagtgagactccatctcaagaaaaaataaaaataaa

SEQ ID NO: 1944 - DNA, 148 bp, synthetic construct
  misc_feature 1..148: note = Synthetic polypeptide
  source 1..148: mol_type = other DNA
aaacttctgtctgacaaactgaaagaggctgaggcaggaggatcgcttgaacccaggaagtggagactgcagtgagccgatatcgcaccacagcgctccagcctggtcgacagagtgagactccatctcaagaaaaaataaaaataaa

SEQ ID NO: 1945 - DNA, 2367 bp, synthetic construct
  misc_feature 1..2367: note = Synthetic polypeptide
  source 1..2367: mol_type = other DNA
atggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggacttctcagaggctttgataaagtcctgtgcctaacctgcaagaggggcatggggaatgaattcagtgcttcccaagtgaacctgaccacagaacctttacagagcacccggcaggatgagagttccacggcgcaaactttgggaa

SEQ ID NO: 1946 - DNA, 578 bp, synthetic construct
  misc_feature 1..578: note = Synthetic polypeptide
  source 1..578: mol_type = other DNA
atgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgtgcctgtaatcccagctactggtgagctgaggtgggagaatcgcttgaacctgggaggcggaggttgcagtgagccaagatcacaccattgcactccagtgtgggcagcagagcgaggctccatctcaaaaagaaagaa

SEQ ID NO: 1947 - DNA, 488 bp, synthetic construct
  misc_feature 1..488: note = Synthetic polypeptide
  source 1..488: mol_type = other DNA
atgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagatgatgaacaacatgggtggtgatgaggatgtagatttaccagaagtagatggagcagatgatgtgcctgtaatcccagctactggtgagctgaggtgggagaatcgcttgaacctgggaggcggaggttgcagtgagccaagatcacaccattgcactccagtgtgggcagcagagcgaggctccatctcaaaaagaaagaa

SEQ ID NO: 1948 - DNA, 479 bp, synthetic construct
  misc_feature 1..479: note = Synthetic polypeptide
  source 1..479: mol_type = other DNA
atgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgtgcctgtaatcccagctactggtgagctgaggtgggagaatcgcttgaacctgggaggcggaggttgcagtgagccaagatcacaccattgcactccagtgtgggcagcagagcgaggctccatctcaaaaagaaagaa

SEQ ID NO: 1949 - DNA, 470 bp, synthetic construct
  misc_feature 1..470: note = Synthetic polypeptide
  source 1..470: mol_type = other DNA
atgcagcctgcttctgcaaagtggtacgatcgaagggactatgtcttcattgaattttgtgttgaagacagtaaggatgttaatgtaaattttgaaaaatccaaacttacattcagttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgtgcctgtaatcccagctactggtgagctgaggtgggagaatcgcttgaacctgggaggcggaggttgcagtgagccaagatcacaccattgcactccagtgtgggcagcagagcgaggctccatctcaaaaagaaagaa

SEQ ID NO: 1950 - DNA, 1391 bp, synthetic construct
  misc_feature 1..1391: note = Synthetic polypeptide
  source 1..1391: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggagaacggcatgaacccgggaggcagggcttgcagtgagccaagatcatgccgctgcactccagcctgggagacaaagtgagactccgtcaaaaaaaaaaaaaa

SEQ ID NO: 1951 - DNA, 1394 bp, synthetic construct
  misc_feature 1..1394: note = Synthetic polypeptide
  source 1..1394: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggagaacggcatgaacccgggaggcagggcttgcagtgagccaagatcatgccgctgcactccagcctgggagacaaagtgagactccgtcaaaaaaaaaaaaaa

SEQ ID NO: 1952 - DNA, 1673 bp, synthetic construct
  misc_feature 1..1673: note = Synthetic polypeptide
  source 1..1673: mol_type = other DNA
atgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggttagtagcttccactgctacctccggcaagacctccaccgaggccgccgccaagacctccaccgaggccaccgccatagccactgccactgcc

SEQ ID NO: 1953 - DNA, 1398 bp, synthetic construct; identical to SEQ ID NO: 948
  misc_feature 1..1398: note = Synthetic polypeptide
  source 1..1398: mol_type = other DNA

SEQ ID NO: 1954 - DNA, 1302 bp, synthetic construct; identical to SEQ ID NO: 949
  misc_feature 1..1302: note = Synthetic polypeptide
  source 1..1302: mol_type = other DNA

SEQ ID NO: 1955 - DNA, 1394 bp, synthetic construct; identical to SEQ ID NO: 1118
  misc_feature 1..1394: note = Synthetic polypeptide
  source 1..1394: mol_type = other DNA

SEQ ID NO: 1956 - DNA, 1625 bp, synthetic construct; identical to SEQ ID NO: 1119
  misc_feature 1..1625: note = Synthetic polypeptide
  source 1..1625: mol_type = other DNA

SEQ ID NO: 1957 - DNA, 1505 bp, synthetic construct; identical to SEQ ID NO: 1120
  misc_feature 1..1505: note = Synthetic polypeptide
  source 1..1505: mol_type = other DNA

SEQ ID NO: 1958 - DNA, 1562 bp, synthetic construct; identical to SEQ ID NO: 1121
  misc_feature 1..1562: note = Synthetic polypeptide
  source 1..1562: mol_type = other DNA

SEQ ID NO: 1959 - DNA, 1601 bp, synthetic construct; identical to SEQ ID NO: 1122
  misc_feature 1..1601: note = Synthetic polypeptide
  source 1..1601: mol_type = other DNA

SEQ ID NO: 1960 - DNA, 1631 bp, synthetic construct; identical to SEQ ID NO: 1123
  misc_feature 1..1631: note = Synthetic polypeptide
  source 1..1631: mol_type = other DNA

SEQ ID NO: 1961 - DNA, 2030 bp, synthetic construct
  misc_feature 1..2030: note = Synthetic polypeptide
  source 1..2030: mol_type = other DNA
atgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacattataggttaatcatgcagtgaaaaaaggcacctttgctgtgaagaaatctggtggcctttcccttatccaagtgatcaaagttatcaatagaagcacagacagacatcatgtgcctcccagtgtcctgcactagggaggccacagcatcacctctgtcctgttcttgcccccaccgacccctgaaatggattacctgaatctaaattttgaggaataatcagacaaacccaagttaaggggcatgctacaaaacaacggccagcacatttcaaaaatgtcagtgacagaaaagaaagacctaaggaagagccatgccaacgaaaggccatattggatcctgaatccagaagggtgcaaggttgctataaaggacatttttggaaaatctgacaattcgaatatgcaccatatattcgacaatagaattctatcaaagttttgtttcctaaaattgaaaatcaa

SEQ ID NO: 1962 - DNA, 1847 bp, synthetic construct
  misc_feature 1..1847: note = Synthetic polypeptide
  source 1..1847: mol_type = other DNA
atgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacattataggttaatcatgcagtgaaaaaaggcacctttgctgtgaagaaatctggtggcctttcccttatccaagtgatcaaagttatcaatagaagcacagacagacatcatgtgcctcccagtgtcctgcactagggaggccacagcatcacctctgtcctgttcttgcccccaccgacccctgaaatggattacctgaatctaaattttgaggaataatcagacaaacccaagttaaggggcatgctacaaaacaacggccagcacatttcaaaaatgtcagtgacagaaaagaaagacctaaggaagagccatgccaacgaaaggccatattggatcctgaatccagaagggtgcaaggttgctataaaggacatttttggaaaatctgacaattcgaatatgcaccatatattcgacaatagaattctatcaaagttttgtttcctaaaattgaaaatcaa

SEQ ID NO: 1963 - DNA, 1395 bp, synthetic construct
  misc_feature 1..1395: note = Synthetic polypeptide
  source 1..1395: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggcaggagaacggcatgaacccgggaggcagggcttgcagtgagccaagatcatgccgctgcactccagcctgggagacaaagtgagactccgtcaaaaaaaaaaaaaa

SEQ ID NO: 1964 - DNA, 1398 bp, synthetic construct
  misc_feature 1..1398: note = Synthetic polypeptide
  source 1..1398: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggcaggagaacggcatgaacccgggaggcagggcttgcagtgagccaagatcatgccgctgcactccagcctgggagacaaagtgagactccgtcaaaaaaaaaaaaaa

SEQ ID NO: 1965 - DNA, 157 bp, synthetic construct; identical to SEQ ID NO: 1500
  misc_feature 1..157: note = Synthetic polypeptide
  source 1..157: mol_type = other DNA

SEQ ID NO: 1966 - DNA, 1058 bp, synthetic construct
  misc_feature 1..1058: note = Synthetic polypeptide
  source 1..1058: mol_type = other DNA
atgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggagaatcacctgagcaccagaattcgaga

SEQ ID NO: 1967 - DNA, 568 bp, synthetic construct
  misc_feature 1..568: note = Synthetic polypeptide
  source 1..568: mol_type = other DNA
atgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagcctaaagaagtaattcagaagaacacacaatccagtgatgtttgcaacaaaggtgatttttagcaacactatttagactagcaaatagtgggaacagcctacttaccaacaattggggaatggttaggcaagtcatggtacatttgactcactgcaattttatatagacattaaaaatgaaaaatacaaagaaaatgtactgatacaaaatactcatataaaagtgtt

SEQ ID NO: 1968 - DNA, 379 bp, synthetic construct
  misc_feature 1..379: note = Synthetic polypeptide
  source 1..379: mol_type = other DNA
atgttctcatgtcctggacactaccacgttgatggctttctaaatccagggagcaggaaaattcagattcgaaacatccctcctcacctgcagtgggaggtgttggatggacttttggctcaatatgggacagtggagaatgtggaacaagcctaaagaagtaattcagaagaacacacaatccagtgatgtttgcaacaaaggtgatttttagcaacactatttagactagcaaatagtgggaacagcctacttaccaacaattggggaatggttaggcaagtcatggtacatttgactcactgcaattttatatagacattaaaaatgaaaaatacaaagaaaatgtactgatacaaaatactcatataaaagtgtt

SEQ ID NO: 1969 - DNA, 195 bp, synthetic construct
  misc_feature 1..195: note = Synthetic polypeptide
  source 1..195: mol_type = other DNA
atgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1970 - DNA, 438 bp, synthetic construct
  misc_feature 1..438: note = Synthetic polypeptide
  source 1..438: mol_type = other DNA
atgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1971 - DNA, 332 bp, synthetic construct
  misc_feature 1..332: note = Synthetic polypeptide
  source 1..332: mol_type = other DNA
atgtctcgggagatgcaggatgtagacctcgctgaggtgaagcctttggtggagaaaggggagaccatcaccggcctcctgcaagagtttgatgtccagacaaaacctgctacaaccccctcttcaactacgaggacatgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1972 - DNA, 240 bp, synthetic construct
  misc_feature 1..240: note = Synthetic polypeptide
  source 1..240: mol_type = other DNA
atgaaccacaaaacctgctacaaccccctcttcaactacgaggacatgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1973 - DNA, 489 bp, synthetic construct
  misc_feature 1..489: note = Synthetic polypeptide
  source 1..489: mol_type = other DNA
atggcagtccctccacctgggatcatgaagcaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1974 - DNA, 471 bp, synthetic construct
  misc_feature 1..471: note = Synthetic polypeptide
  source 1..471: mol_type = other DNA
atgacggtgccagctgcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1975 - DNA, 600 bp, synthetic construct
  misc_feature 1..600: note = Synthetic polypeptide
  source 1..600: mol_type = other DNA
atgtcaggcagccgagagtcctgcaccgtggggtgtgtatgtgtgttcacgcgcatgcgtgtgcctgtgtgtctgtgcgtctgcatcaccaaccttctgttagggctaactgtgaggctgaagcttgcactatgcctatacgtggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1976 - DNA, 371 bp, synthetic construct; identical to SEQ ID NO: 1008
  misc_feature 1..371: note = Synthetic polypeptide
  source 1..371: mol_type = other DNA

SEQ ID NO: 1977 - DNA, 272 bp, synthetic construct; identical to SEQ ID NO: 1009
  misc_feature 1..272: note = Synthetic polypeptide
  source 1..272: mol_type = other DNA

SEQ ID NO: 1978 - DNA, 3992 bp, synthetic construct; identical to SEQ ID NO: 120
  misc_feature 1..3992: note = Synthetic polypeptide
  source 1..3992: mol_type = other DNA

SEQ ID NO: 1979 - DNA, 3845 bp, synthetic construct; identical to SEQ ID NO: 121
  misc_feature 1..3845: note = Synthetic polypeptide
  source 1..3845: mol_type = other DNA

SEQ ID NO: 1980 - DNA, 1515 bp, synthetic construct
  misc_feature 1..1515: note = Synthetic polypeptide
  source 1..1515: mol_type = other DNA
atggtgtgcaccaggaagaccaaaactttggtgtccacttgcgtgatcctgagcggcatgactaacatcatctgcctgctctacgtgggctgggtcaccaactacatcgccagcgtgtatgtgcgggggcaggagccggcgcccgacaagaagctggaggaagacaaaggggacactctgaagattattgagcggctggaccacctggagaatgtcatcaagcagcacattcaagaggctcctgccaagcctgaggaggcagaggccgagcccttcacagactcctctctgtttgcacactggggccaggagctcagccccgaaggccggcgcgtggccctgaagcaattccagtactacggctacaacgcctacctcagcgaccgcctgcccctggaccggcccctgcctgacctcagacccagtgggtgccgtaacctctcatttcctgacagcctgccagaggtgagcatcgtgttcatcttcgtcaatgaagcgctttcagtgctgctgcgctccatccactcggccatggaacgcacgcccccacatctgctcaaggagatcattctggtggatgacaacagcagtaacgaggaactgaaggagaagctgaccgaatatgtggacaaggtgaacagccagaagccaggcttcatcaaagtcgtgcgtcacagcaagcaggaaggcctcatccgctccagggtcagtggctggagggcggccactgcccctgtggtggcactctttgatgcccacgtggagttcaatgtgggctgggctgaacctgtactcacccgcatcaaggagaaccggaagcggatcatctcgccatcctttgataacatcaaatatgacaactttgagatagaagagtacccgctggctgcccagggctttgactgggagctgtggtgccgctacctaaatccccccaaggcctggtggaagctggagaactccacagcgccaatcaggagccctgccctcattggctgcttcattgtggaccggcagtacttccaggagatcggcctgctggacgaaggcatggaagtctacgggggcgagaatgtggagcttgggatcaggcactatttacaataacaaagacatggaaccaacccaaatgcctgtcaatgatagcctggataaagaaaatgtggtacatatacaccatggaatactatgcagccataaaaaggaatgagaacccgtcctttgtggggacatggatgaagctggaagccatcatcctcagcaaactaacacaggaacagaaaaccaaacaccacatgttctcacccataagtggaagttgaacactgagaacacatggacacagagaagggaacaacacacatgaaggcctgtagggggttgggggttgagggaagggaacttaaaggatgggtccataggtgcagcaaaccaccatggcacatgtatacctatggaacaaacctgcatgttctgcactcgtatcccatttttagaagaaataatgaaaaaaaa

SEQ ID NO: 1981 - DNA, 3220 bp, synthetic construct; identical to SEQ ID NO: 248
  misc_feature 1..3220: note = Synthetic polypeptide
  source 1..3220: mol_type = other DNA

SEQ ID NO: 1982 - DNA, 2721 bp, synthetic construct; identical to SEQ ID NO: 962
  misc_feature 1..2721: note = Synthetic polypeptide
  source 1..2721: mol_type = other DNA

SEQ ID NO: 1983 - DNA, 2549 bp, synthetic construct; identical to SEQ ID NO: 963
  misc_feature 1..2549: note = Synthetic polypeptide
  source 1..2549: mol_type = other DNA

SEQ ID NO: 1984 - DNA, 828 bp, synthetic construct
  misc_feature 1..828: note = Synthetic polypeptide
  source 1..828: mol_type = other DNA
atgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgactctgttgaaagtacccagcagcaaagaaggttctcaccagatgcagctccttgatcttggccttctcagcctccattaactgtaagaaataaattcctttctttataaattacccagtttcaagtattgtgttataagcaacagaaaacaaagaca

SEQ ID NO: 1985 - DNA, 775 bp, synthetic construct
  misc_feature 1..775: note = Synthetic polypeptide
  source 1..775: mol_type = other DNA
atgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggcacttggccaacaaaggtaagatgttttgcttaataaacaagttaaaaataaagcctgcatccaaacagatgaggacgcaagcaagcgcactcttcagatgtcacttctcacgggaggcctctgtgattgcagaaggaaaggccccagcagaactcaccatctgccgcctgaggctccaccacctcgaagacatccttgcaagatccacagactggcccagaccaggaggtttctgtcttcttcttgtgtcttcttcactctcctggactggttcgtgaaccctttctcctatctctgtttcctctggatgttaagtgctactttctttgttgtggaacgttaacctgtaacatgtatatactgattaagtacactattacgttgtcgtgtgcaatattggctgacatgtgcagtggcttgagcccgtgtgaccgcagctctcactactgagggaaaggagcactaagcagcatgcctccttgggaacgccgtgtggctcgtggctttagggattgaaatagcctcaataaaattctgacattgtgaaagacacaggcatgcttggatgtgattatctctaactttgcactgctcatgaca

SEQ ID NO: 1986 - DNA, 592 bp, synthetic construct
  misc_feature 1..592: note = Synthetic polypeptide
  source 1..592: mol_type = other DNA
atggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgtgaactgtgagtccacttaagtggcttctctttcgcctctgccacccctgagacagcaggaccaaccctcccttcctcctcctcagcctgctctacgtgaagatgatgaggatgaagacctttatgacgatccacttccacttaatgaaaagtcagttcattttctcttccttgtgatttccttcattgcattttcttcctctagcttactttattataagaatccaatatataatacttgtaacatgcaaaatatatgttaatcgaccatttatgttattggcaaacattctggtcagcatcaggctatgagtaaattgtgggggagtcaaaaataatatgcagattttcaattgtgttgggggtggttcccccaacccctgagttgttcaaggattaactg

SEQ ID NO: 1987 - DNA, 770 bp, synthetic construct
  misc_feature 1..770: note = Synthetic polypeptide
  source 1..770: mol_type = other DNA
atgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggctaaggtgtttcattgtaacctgaatggaccaag

SEQ ID NO: 1988 - DNA, 1193 bp, synthetic construct
  misc_feature 1..1193: note = Synthetic polypeptide
  source 1..1193: mol_type = other DNA
atgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggctaaggtgtttcattgtaacctgaatggaccaag

SEQ ID NO: 1989 - DNA, 1705 bp, synthetic construct
  misc_feature 1..1705: note = Synthetic polypeptide
  source 1..1705: mol_type = other DNA
atgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctggagtgcagtggcgtgatctcagctcgctacaacctccacctcccagccgcctgccttggcctcccaaagtgccgagattgcagcctctgcctggctgccaccccatctgggaagtgaggagcgtctctgcctggccgcccatcgtctgggatgtgaggagcccctctgcccggccgcccagtcttggaagtgaggagcgcatcttcccggccgccatcacgtctgggaagtgaggagcgtctctgcccggctgcccatcgtctcagatgtggggagcacctctgccccgccgccccgtctgggatgtgaggagcgcctctgtccggccgcgacccggtctgggaactgaggagtgtctctgcccgaccgccaccccgtctgggaggtgaggagcgtctttgcccagccgccccgtctgagaagtgaggagcccctccgcctggcagccgccccgtctgggaagtgaggagcgtctccgcccggcagccgccccgtccgggaggtggggggcagccgccgcccggccagccgccctgtccaggagggaggtggggggcaacccccgcccggccagccaccccgtccgggagggaggttgggggtgcctctgaccggccgccccgtctgggaagtgaggagcccctctgcccggcggccaccccgtctgggaggagtacccaacagctcgttgagaacgggccatgatgacgatggcggttttgtcgaatagaaaagggggaaatgtggggaaaagaaagagagatcagattgttactgtgtctgtgtggaaagaggtagacatgggagactccattttgttctgtactaagaaaaattcttctgccttgggatgctgttaatctataaccttacccccaaccccgtgctctctgaaacatgtgctgtgtccactcagggttaaatggataaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacccttgttcacatgtttatctgctgaccttccctccactattgtcctatgaccctgccaaatccccctctccgagaaacacccaagaatgatcaataaatactattaaaaaaaaaaa

SEQ ID NO: 1990 - DNA, 817 bp, synthetic construct
  misc_feature 1..817: note = Synthetic polypeptide
  source 1..817: mol_type = other DNA
atgagtttcctgatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaacttcactttccttatgtgcaaaatggataacaccatggcataagacaatcccatgaagataagatataaaagaagataatgtttgaaaag

SEQ ID NO: 1991 - DNA, 1231 bp, synthetic construct; identical to SEQ ID NO: 1238
  misc_feature 1..1231: note = Synthetic polypeptide
  source 1..1231: mol_type = other DNA

SEQ ID NO: 1992 - DNA, 193 bp, synthetic construct
  misc_feature 1..193: note = Synthetic polypeptide
  source 1..193: mol_type = other DNA
atggcctggtggaaatcctgggagaatgaataaacagactaggttgaatccatacaatggaatggtagcagacaataaaaagaaaatgaactattgatgccccctactgcacagcagaagctctgaatcgtgttcctgaatgaaagaagtcaggtatgaaagaataaacattgtatgattccatttatatgaa

SEQ ID NO: 1993 - DNA, 254 bp, synthetic construct
  misc_feature 1..254: note = Synthetic polypeptide
  source 1..254: mol_type = other DNA
atggctttgaggggccctgcgggcttggggcccggctctcgaaggccgttggacgaagcggtggcaggggccgagggccgcgaggcgccggcccttgtggcggcgggaggcgcgccagaggacgatgaagaggacgatggccgtggccggggcctgctgcgctgggacagcttctccgcctggctgcactgcgtgtgtgtggtgggcttcgacctggagctgggccaggccgtggaggctcaccttgccccact

SEQ ID NO: 1994 - DNA, 966 bp, synthetic construct
  misc_feature 1..966: note = Synthetic polypeptide
  source 1..966: mol_type = other DNA
atggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggccgggtgtggtggctgatcacgccactcccagcactttgggaggccaacgcgggcagatcatgaggtcaacagatcgagaccatcctggccaacatggtgaaaccctgtctctactaaaatacaaaaatcagtaatcccagctactcgggaggctgagacaggagaatcgcttgaacccaggaggcagaagttgcagtgagctgagattgtgccgagattgcgccactgcactccagcctggtgacagagcgagactccatctcaaaaaaaaaaaaa

SEQ ID NO: 1995 - DNA, 432 bp, synthetic construct
  misc_feature 1..432: note = Synthetic polypeptide
  source 1..432: mol_type = other DNA
atggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggccgggtgtggtggctgatcacgccactcccagcactttgggaggccaacgcgggcagatcatgaggtcaacagatcgagaccatcctggccaacatggtgaaaccctgtctctactaaaatacaaaaatcagtaatcccagctactcgggaggctgagacaggagaatcgcttgaacccaggaggcagaagttgcagtgagctgagattgtgccgagattgcgccactgcactccagcctggtgacagagcgagactccatctcaaaaaaaaaaaaa

SEQ ID NO: 1996 - DNA, 190 bp, synthetic construct
  misc_feature 1..190: note = Synthetic polypeptide
  source 1..190: mol_type = other DNA
atggaggcggtggtgttcgtcttctctctcctcgattgttgcgcgctcatcttcctctcggtctacttcgccagttgcagtggctgacacctgtccccagtactttgggaggccgaggagggagaatcacttgagcccagcggttcgagaccagctctggtaacatagggagacttcctctctacaaaaa

SEQ ID NO: 1997 - DNA, 361 bp, synthetic construct; identical to SEQ ID NO: 1916
  misc_feature 1..361: note = Synthetic polypeptide
  source 1..361: mol_type = other DNA

SEQ ID NO: 1998 - DNA, 2312 bp, synthetic construct
  misc_feature 1..2312: note = Synthetic polypeptide
  source 1..2312: mol_type = other DNA
atggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaagatgatgttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctctctgaaaacaaccactggtacctctcgccaggaccactgcagcagccttccagccggccctgtttcctcatccaaaccattcacctgccagcagcaacactgatcttcctgagatatacccagaccaggccactcccctgtccacgtcctgcaggggttcctgctgcgtgcaatatagaagccaaatgcct

SEQ ID NO: 1999 - DNA, 3093 bp, synthetic construct; identical to SEQ ID NO: 341
  misc_feature 1..3093: note = Synthetic polypeptide
  source 1..3093: mol_type = other DNA

SEQ ID NO: 2000 - DNA, 2979 bp, synthetic construct; identical to SEQ ID NO: 342
  misc_feature 1..2979: note = Synthetic polypeptide
  source 1..2979: mol_type = other DNA

SEQ ID NO: 2001 - DNA, 3078 bp, synthetic construct; identical to SEQ ID NO: 343
  misc_feature 1..3078: note = Synthetic polypeptide
  source 1..3078: mol_type = other DNA

SEQ ID NO: 2002 - DNA, 3072 bp, synthetic construct; identical to SEQ ID NO: 346
  misc_feature 1..3072: note = Synthetic polypeptide
  source 1..3072: mol_type = other DNA

SEQ ID NO: 2003 - DNA, 1935 bp, synthetic construct; identical to SEQ ID NO: 347
  misc_feature 1..1935: note = Synthetic polypeptide
  source 1..1935: mol_type = other DNA

SEQ ID NO: 2004 - DNA, 1096 bp, synthetic construct; identical to SEQ ID NO: 348
  misc_feature 1..1096: note = Synthetic polypeptide
  source 1..1096: mol_type = other DNA

SEQ ID NO: 2005 - DNA, 902 bp, synthetic construct; identical to SEQ ID NO: 349
  misc_feature 1..902: note = Synthetic polypeptide
  source 1..902: mol_type = other DNA

SEQ ID NO: 2006 - DNA, 874 bp, synthetic construct; identical to SEQ ID NO: 350
  misc_feature 1..874: note = Synthetic polypeptide
  source 1..874: mol_type = other DNA

SEQ ID NO: 2007 - DNA, 1168 bp, synthetic construct; identical to SEQ ID NO: 1703
  misc_feature 1..1168: note = Synthetic polypeptide
  source 1..1168: mol_type = other DNA

SEQ ID NO: 2008 - DNA, 1563 bp, synthetic construct
  misc_feature 1..1563: note = Synthetic polypeptide
  source 1..1563: mol_type = other DNA
atggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggccgaagctggactgtactgctgccatctcggctcactgcaacctccctgcctgattctcctgcctcagcctgccgagtgcctgcgattgcaggcgtgcgccaccacgcctgactggttttcgtatttttttggtggaaacggggtttcgctgtgttggccgggctggtctccagctcctaaccgcgagtgatctgccagcctcggcctcccgaggtgccgggattgcagacggagtctggttcactcagtgctcaatggtgcccaggctggagtgcagtggcgtgatctcggctcgctacaacctccacctcccagccgcctgccttggcctcccaaagtgccgagagtgcagcctctgcccggccgccaccccgtctgggaagtgaggagtgtctctgcctggctgcccatcgtctgggacgtgagcagcccctctgcctggctgcccagtctggaaagtgaggagcgtctctgccccgccgccatcccatctaggaagtgaggagcgcctcttcccggccgccatcccatctaggaagtgaggagcgtctctgcccggccgcccatcgtctgagatgtggggagcacctctgcccagccgcaaccccatctgggaggtgaggagcaactctgcccagccgccccgtctgagaagtgaggagaccctctgcctggcaaccgccccgtctgagaagtaaggagcccctctgcccagcagccgccccgtctgagaagtgaggagcccctccgcccggcagccaccctgtctgggaagtgaggagcgtctccgcccggcagccaccccgtccgggagggaggtgggggtcagcccccgccaggccagccgccccatccgggaggaaggtggggggttcagccccccgcccggccagccgccccgtctgggagggaggtcggggggtcagtcccccgtccggccagccgccctgtctgggaggtgaggggcgcctctgcccagctgcccctactgggaagtgaggagcccctctgcccggccagccgccccatccgggagggaggtgggggggtcagcccgccgcccgggcagccgccccgtccgggagggaggtggggggtcagccccccgcccggccagccgccccgtccgggaggcgaggggcgcctctgcccggccgtccctactgggaagtgaggagcccctctgcccggccaccaccccgtctgggaggtgtacccaacagctcattgagagcgggccatgatgacagtggcggttttgtggagtggaggggggggagaggtggggaaaagattgagaaatcggatggttgccgtgtctgtgtagaaagaagtagacatgggagacttttcattttgttctgtactaagaaaaattctt

SEQ ID NO: 2009 - DNA, 906 bp, synthetic construct; identical to SEQ ID NO: 1888
  misc_feature 1..906: note = Synthetic polypeptide
  source 1..906: mol_type = other DNA

SEQ ID NO: 2010 - DNA, 1077 bp, synthetic construct; identical to SEQ ID NO: 1889
  misc_feature 1..1077: note = Synthetic polypeptide
  source 1..1077: mol_type = other DNA

SEQ ID NO: 2011 - DNA, 835 bp, synthetic construct
  misc_feature 1..835: note = Synthetic polypeptide
  source 1..835: mol_type = other DNA
atgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaaggagggactttctctggaatttcctgatatgaccaagaaagcttcttatcaaaagaagcacaattgccttcggttacctcattatctactgcagaaaagaagacgagaatgcaaccatacctagatggacttttccacaagctaaagctggcctcttgatctcattcagattccaaagagaatcatttacaagttaatttctgtctccttggtccattccttctctctaataatcatttactgttcctcaaagaattgtctacattacccatctcctcttttgcctctgagaaagagtatataagcttctgtaccccactggggggttggggtaatattctgtggtcctcagccctgtaccttaataaatttgtatgccttttctcttattaatcttgtcagttgattttcagtgaactttcagaggccaaaagggaggttttctcttggcccctgca

SEQ ID NO: 2012 - DNA, 5801 bp, synthetic construct
  misc_feature 1..5801: note = Synthetic polypeptide
  source 1..5801: mol_type = other DNA
atggccggccggtcccacccgggcccgctgcggccgctgctgccgctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcacgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggattttcggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccactctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagccaggcgtggtggtacacacctgtagctccagctactccggaggctgaggcaggaggatcacttgaatccaggaggttgaggcagcagcaagctgtgattgcaccactgcactccagcctgggtgacagagcgagaacctgtctaaaaaa

SEQ ID NO: 2013 - DNA, 708 bp, synthetic construct
  misc_feature 1..708: note = Synthetic polypeptide
  source 1..708: mol_type = other DNA
ccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccgaaatcccgcaaggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagccaggcgtggtggtacacacctgtagctccagctactccggaggctgaggcaggaggatcacttgaatccaggaggttgaggcagcagcaagctgtgattgcaccactgcactccagcctgggtgacagagcgagaacctgtctaaaaaa

SEQ ID NO: 2014 - DNA, 47 bp, synthetic construct
  misc_feature 1..47: note = Synthetic polypeptide
  source 1..47: mol_type = other DNA
atgagcctgcagagcgcgcagtacctccggattgctgggaggagtaa

SEQ ID NO: 2015 - DNA, 2179 bp, synthetic construct
  misc_feature 1..2179: note = Synthetic polypeptide
  source 1..2179: mol_type = other DNA
atgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgggctccaccaggtcctcacagagaaaatgtgagaagaatctcatgcttccagtagggggagcagacaaagaaccattttgaaatagacagagcattctgttcttaaggcagtctgccgtcaggaacaactatttaaccacaggcagccctgctgaggttttatcagagcctggtctagctggagaaagggaaatacccaaccccagctccctccagctatgctgaccctacttaaagaggtgaaaaaagcctcagaagcacttgtgaagttcacagccaaggggcgcaggctcactaaaagactgagacctaattctactcataggtctatagaatacctcccctcacctcatacctcatcactacattactaaagcttatttatcagtttcttccatccattttcaacaaaaaaattacaaagcatacttcaaggtagaaaacagtttgaaaagacagagcaagtaccagaaccacactcagatatggcagggatattggaattattagatcgggaatttaaaacaaccatgattaacaagctaagagcacaaatgaacaaggtacacaacatgcaagaacagatgggtaatgaaagcagatagacagaaattctaataataaaaaataaatgctagagataaaaaacattataacagaaatgacgaacgccttttgtgggctcattagtagactagacacagctgacattagaatctgagcttgagggtatgtcaatagaactgttttttcagttctttctcaactgaaaagcaaaaataaaaaaagactgagaaaagaagaacagaatatgcaagaactgtgggggaaactatgaaagatgtaacttgtgtaaaaggaatactagaacaagaaatagagaaagcaacataataaatattggagaaagtaatgactgagaatttccaaaaattagtgtcagacataaaaaaatacctgtgtatattatattcaaactgtagaaaatgaaagataacaaaaatcctgaaagaagccatggttgggggggaaacaacttatctatagtggaacaaagataagaattaaatctcacttcctcacagaaaccttgcaagcaagaaaagactggagtaaaatatttactgttgggtgagaaaacagcaacacggaattctatatcttgctaaattatccttcaaaaatgaagaaaaaataaagactttctcaagacaaacaaaaatgaagagaatatgttgccagtagtcctgccttgcaagaaatgttaaaagaagctcttcaccaagaaggaaaattatataggtcagaaactcggatctacataaagaaaggaaaagcattagagaagaaataagatctaacagataaatgttcgttcaaaataataatagcaacaatgtcttcaatgtttatactttatgtgtaagtgaaatgaatgacagcattgatacaaaggatgcgagggaggaattagcgata

SEQ ID NO: 2016 - DNA, 1581 bp, synthetic construct
  misc_feature 1..1581: note = Synthetic polypeptide
  source 1..1581: mol_type = other DNA
ggaccctgctgcaggagcagggcaccaagactgtgaggcagaacctggagccgttgttcgagcagtacatcaacaacctcaggaggcagctggacagcatcgggctccaccaggtcctcacagagaaaatgtgagaagaatctcatgcttccagtagggggagcagacaaagaaccattttgaaatagacagagcattctgttcttaaggcagtctgccgtcaggaacaactatttaaccacaggcagccctgctgaggttttatcagagcctggtctagctggagaaagggaaatacccaaccccagctccctccagctatgctgaccctacttaaagaggtgaaaaaagcctcagaagcacttgtgaagttcacagccaaggggcgcaggctcactaaaagactgagacctaattctactcataggtctatagaatacctcccctcacctcatacctcatcactacattactaaagcttatttatcagtttcttccatccattttcaacaaaaaaattacaaagcatacttcaaggtagaaaacagtttgaaaagacagagcaagtaccagaaccacactcagatatggcagggatattggaattattagatcgggaatttaaaacaaccatgattaacaagctaagagcacaaatgaacaaggtacacaacatgcaagaacagatgggtaatgaaagcagatagacagaaattctaataataaaaaataaatgctagagataaaaaacattataacagaaatgacgaacgccttttgtgggctcattagtagactagacacagctgacattagaatctgagcttgagggtatgtcaatagaactgttttttcagttctttctcaactgaaaagcaaaaataaaaaaagactgagaaaagaagaacagaatatgcaagaactgtgggggaaactatgaaagatgtaacttgtgtaaaaggaatactagaacaagaaatagagaaagcaacataataaatattggagaaagtaatgactgagaatttccaaaaattagtgtcagacataaaaaaatacctgtgtatattatattcaaactgtagaaaatgaaagataacaaaaatcctgaaagaagccatggttgggggggaaacaacttatctatagtggaacaaagataagaattaaatctcacttcctcacagaaaccttgcaagcaagaaaagactggagtaaaatatttactgttgggtgagaaaacagcaacacggaattctatatcttgctaaattatccttcaaaaatgaagaaaaaataaagactttctcaagacaaacaaaaatgaagagaatatgttgccagtagtcctgccttgcaagaaatgttaaaagaagctcttcaccaagaaggaaaattatataggtcagaaactcggatctacataaagaaaggaaaagcattagagaagaaataagatctaacagataaatgttcgttcaaaataataatagcaacaatgtcttcaatgtttatactttatgtgtaagtgaaatgaatgacagcattgatacaaaggatgcgagggaggaattagcgata

SEQ ID NO: 2017 - DNA, 1849 bp, synthetic construct
  misc_feature 1..1849: note = Synthetic polypeptide
  source 1..1849: mol_type = other DNA
atgtctcgccagtcaagtgtgtccttccggagcgggggcagtcgtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgggctccaccaggtcctcacagagaaaatgtgagaagaatctcatgcttccagtagggggagcagacaaagaaccattttgaaatagacagagcattctgttcttaaggcagtctgccgtcaggaacaactatttaaccacaggcagccctgctgaggttttatcagagcctggtctagctggagaaagggaaatacccaaccccagctccctccagctatgctgaccctacttaaagaggtgaaaaaagcctcagaagcacttgtgaagttcacagccaaggggcgcaggctcactaaaagactgagacctaattctactcataggtctatagaatacctcccctcacctcatacctcatcactacattactaaagcttatttatcagtttcttccatccattttcaacaaaaaaattacaaagcatacttcaaggtagaaaacagtttgaaaagacagagcaagtaccagaaccacactcagatatggcagggatattggaattattagatcgggaatttaaaacaaccatgattaacaagctaagagcacaaatgaacaaggtacacaacatgcaagaacagatgggtaatgaaagcagatagacagaaattctaataataaaaaataaatgctagagataaaaaacattataacagaaatgacgaacgccttttgtgggctcattagtagactagacacagctgacattagaatctgagcttgagggtatgtcaatagaactgttttttcagttctttctcaactgaaaagcaaaaataaaaaaagactgagaaaagaagaacagaatatgcaagaactgtgggggaaactatgaaagatgtaacttgtgtaaaaggaatactagaacaagaaatagagaaagcaacataataaatattggagaaagtaatgactgagaatttccaaaaattagtgtcagacataaaaaaatacctgtgtatattatattcaaactgtagaaaatgaaagataacaaaaatcctgaaagaagccatggttgggggggaaacaacttatctatagtggaacaaagataagaattaaatctcacttcctcacagaaaccttgcaagcaagaaaagactggagtaaaatatttactgttgggtgagaaaacagcaacacggaattctatatcttgctaaattatccttcaaaaatgaagaaaaaataaagactttctcaagacaaacaaaaatgaagagaatatgttgccagtagtcctgccttgcaagaaatgttaaaagaagctcttcaccaagaaggaaaattatataggtcagaaactcggatctacataaagaaaggaaaagcattagagaagaaataagatctaacagataaatgttcgttcaaaataataatagcaacaatgtcttcaatgtttatactttatgtgtaagtgaaatgaatgacagcattgatacaaaggatgcgagggaggaattagcgata

SEQ ID NO: 2018 - DNA, 2713 bp, synthetic construct; identical to SEQ ID NO: 1273
  misc_feature 1..2713: note = Synthetic polypeptide
  source 1..2713: mol_type = other DNA

SEQ ID NO: 2019 - DNA, 228 bp, synthetic construct; identical to SEQ ID NO: 1274
  misc_feature 1..228: note = Synthetic polypeptide
  source 1..228: mol_type = other DNA

SEQ ID NO: 2020 - DNA, 572 bp, synthetic construct; identical to SEQ ID NO: 159
  misc_feature 1..572: note = Synthetic polypeptide
  source 1..572: mol_type = other DNA

SEQ ID NO: 2021 - DNA, 281 bp, synthetic construct
  misc_feature 1..281: note = Synthetic polypeptide
  source 1..281: mol_type = other DNA
atgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccgggcccaccatcaccaccgcctctggccgccacccccatcttccacctgtgccctcaccaccac

SEQ ID NO: 2022 - DNA, 248 bp, synthetic construct
  misc_feature 1..248: note = Synthetic polypeptide
  source 1..248: mol_type = other DNA
atgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccgggcccaccatcaccaccgcctctggccgccacccccatcttccacctgtgccctcaccaccac

SEQ ID NO: 2023 - DNA, 1487 bp, synthetic construct
  misc_feature 1..1487: note = Synthetic polypeptide
  source 1..1487: mol_type = other DNA
atggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaa

SEQ ID NO: 2024 - DNA, 1538 bp, synthetic construct
  misc_feature 1..1538: note = Synthetic polypeptide
  source 1..1538: mol_type = other DNA
atggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaa

SEQ ID NO: 2025 - DNA, 1427 bp, synthetic construct
  misc_feature 1..1427: note = Synthetic polypeptide
  source 1..1427: mol_type = other DNA
atggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaa

SEQ ID NO: 2026 - DNA, 3308 bp, synthetic construct; identical to SEQ ID NO: 428
  misc_feature 1..3308: note = Synthetic polypeptide
  source 1..3308: mol_type = other DNA

SEQ ID NO: 2027 - DNA, 3203 bp, synthetic construct; identical to SEQ ID NO: 429
  misc_feature 1..3203: note = Synthetic polypeptide
  source 1..3203: mol_type = other DNA

SEQ ID NO: 2028 - DNA, 2849 bp, synthetic construct; identical to SEQ ID NO: 430
  misc_feature 1..2849: note = Synthetic polypeptide
  source 1..2849: mol_type = other DNA

SEQ ID NO: 2029 - DNA, 388 bp, synthetic construct; identical to SEQ ID NO: 431
  misc_feature 1..388: note = Synthetic polypeptide
  source 1..388: mol_type = other DNA

SEQ ID NO: 2030 - DNA, 55 bp, synthetic construct; identical to SEQ ID NO: 291
  misc_feature 1..55: note = Synthetic polypeptide
  source 1..55: mol_type = other DNA

SEQ ID NO: 2031 - DNA, 25 bp, synthetic construct
  misc_feature 1..25: note = Synthetic polypeptide
  source 1..25: mol_type = other DNA
atgagcgtcctttcgtttttttaaa

SEQ ID NO: 2032 - DNA, 1091 bp, synthetic construct
  misc_feature 1..1091: note = Synthetic polypeptide
  source 1..1091: mol_type = other DNA
atggcctggtggaaatcctgggggcctcatagacattcactccacccaacaaccacagaatatacattcttcctatctgtacacagaacatattctcagatcaaccatatgctgagtcataaagcaagtctcaataaattttaaaaaattgaaattataccaaacacactcttggaccacagtgcgataaaaatagaaactaatatcaagaagatctctcaaaactacacaaatacatggatattaaacaactttttcctgattaactcctaggtgaaaatcaaaattaaggcagaaataaaaaaatctttgaaagtaatgaaaatggagatacaacttaacaaagtctctgggatacagccaaagcagtgttaagaggaaagtttataacgttaaatgccttcaccaagaagttaaaacaatctcaaattaacagtctaagtttgcacctagaagaactagagaaaaagagcaaaccaaccccaaagctagcagaagaaaataaataactaaaattaaagaagaacttaatgaaattgagatgcaaaaatccatacaaaagataaatgaaaccaaaagttgattttcaaaaaaataaacaagactgagagaccactagctagattaacaaagaaaaaagaatttccaaataagtactgtgagaaatgacaaagatattacaattcatcttcatttgcagatgaagatactgcagcttagtcagcagactaagtcacctaaatgctctgccagaagcagaatttgtactcaggaatgtccaactgcaaagtccatgtgcttgaacagtatggcatactgatacatgcagaaatacaaaagatcctcagaaaatactgtgagtaattctatgcacacaaattagaaaatctagaggaaatggataaattcctgggaacatacaatctcccaagattgaatcaggaagagactgataccctgactagaccaatatcaagctctgaaattaaaccaataataaaaaacctaccaacgacaacaacaaaaagccctggactagatggattcacagctaaattctatcagacatacaaagaactggtaccaatcct

SEQ ID NO: 2033 - DNA, 393 bp, synthetic construct; identical to SEQ ID NO: 1400
  misc_feature 1..393: note = Synthetic polypeptide
  source 1..393: mol_type = other DNA

SEQ ID NO: 2034 - DNA, 272 bp, synthetic construct; identical to SEQ ID NO: 1401
  misc_feature 1..272: note = Synthetic polypeptide
  source 1..272: mol_type = other DNA

SEQ ID NO: 2035 - DNA, 3995 bp, synthetic construct
  misc_feature 1..3995: note = Synthetic polypeptide
  source 1..3995: mol_type = other DNA
atggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaaggcccacgatgccagcaggatgtggacgagtgtgctggccccgcaccctgtggccctcatggtatctgcaccaacctggcagggagtttcagctgcacctgccatggagggtacactggcccttcctgcgatcaggacatcaatgactgtgaccccaacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgggcgtagtggcagctgcctgtaatcccagctactcgggaggctgaggcaggagaatcacttgaacccgggaggcggaggttgcagtgagccatcacgccattgcactccagcctggcgactgagtgacactccgtctcaaaaaacaaagaaacaa

SEQ ID NO: 2036 - DNA, 3836 bp, synthetic construct
  misc_feature 1..3836: note = Synthetic polypeptide
  source 1..3836: mol_type = other DNA
gggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgggcgtagtggcagctgcctgtaatcccagctactcgggaggctgaggcaggagaatcacttgaacccgggaggcggaggttgcagtgagccatcacgccattgcactccagcctggcgactgagtgacactccgtctcaaaaaacaaagaaacaa

SEQ ID NO: 2037 - DNA, 506 bp, synthetic construct; identical to SEQ ID NO: 1096
  misc_feature 1..506: note = Synthetic polypeptide
  source 1..506: mol_type = other DNA

SEQ ID NO: 2038 - DNA, 1412 bp, synthetic construct
  misc_feature 1..1412: note = Synthetic polypeptide
  source 1..1412: mol_type = other DNA
atggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggcaggagaatggcgtgaacctgggagtcggagcttgcagtgagccgagatggcgccactgcactccagcctgggcgacagagcgagactccgtctcagaaaaaa

SEQ ID NO: 2039 - DNA, 102 bp, synthetic construct; identical to SEQ ID NO: 258
  misc_feature 1..102: note = Synthetic polypeptide
  source 1..102: mol_type = other DNA

SEQ ID NO: 2040 - DNA, 82 bp, synthetic construct; identical to SEQ ID NO: 257
  misc_feature 1..82: note = Synthetic polypeptide
  source 1..82: mol_type = other DNA

SEQ ID NO: 2041 - DNA, 4120 bp, synthetic construct; identical to SEQ ID NO: 1356
  misc_feature 1..4120: note = Synthetic polypeptide
  source 1..4120: mol_type = other DNA

SEQ ID NO: 2042 - DNA, 4132 bp, synthetic construct; identical to SEQ ID NO: 1357
  misc_feature 1..4132: note = Synthetic polypeptide
  source 1..4132: mol_type = other DNA

SEQ ID NO: 2043 - DNA, 4120 bp, synthetic construct; identical to SEQ ID NO: 1358
  misc_feature 1..4120: note = Synthetic polypeptide
  source 1..4120: mol_type = other DNA

SEQ ID NO: 2044 - DNA, 4024 bp, synthetic construct; identical to SEQ ID NO: 1359
  misc_feature 1..4024: note = Synthetic polypeptide
  source 1..4024: mol_type = other DNA

SEQ ID NO: 2045 - DNA, 4531 bp, synthetic construct; identical to SEQ ID NO: 1360
  misc_feature 1..4531: note = Synthetic polypeptide
  source 1..4531: mol_type = other DNA

SEQ ID NO: 2046 - DNA, 4054 bp, synthetic construct; identical to SEQ ID NO: 1361
  misc_feature 1..4054: note = Synthetic polypeptide
  source 1..4054: mol_type = other DNA

SEQ ID NO: 2047 - DNA, 4078 bp, synthetic construct; identical to SEQ ID NO: 1362
  misc_feature 1..4078: note = Synthetic polypeptide
  source 1..4078: mol_type = other DNA

SEQ ID NO: 2048 - DNA, 4201 bp, synthetic construct; identical to SEQ ID NO: 1363
  misc_feature 1..4201: note = Synthetic polypeptide
  source 1..4201: mol_type = other DNA

SEQ ID NO: 2049 - DNA, 4189 bp, synthetic construct; identical to SEQ ID NO: 1364
  misc_feature 1..4189: note = Synthetic polypeptide
  source 1..4189: mol_type = other DNA

SEQ ID NO: 2050 - DNA, 210 bp, synthetic construct; identical to SEQ ID NO: 1365
  misc_feature 1..210: note = Synthetic polypeptide
  source 1..210: mol_type = other DNA

SEQ ID NO: 2051 - DNA, 3304 bp, synthetic construct
  misc_feature 1..3304: note = Synthetic polypeptide
  source 1..3304: mol_type = other DNA
atggcaccaccagctcataaaagcatacttgaacgcagtgaaaatgttctcatgtctccatggaaagggaaattaattgttcaagaccgtatgctatgtgatatagctctttggtccacttacggtgcaatgattccaacacagctaccgcaggaactagattttaaatatgtaatgaaagtgtcttccttgaaaaaaagactaccagaggctgccttcagaaaacagaattacttggaggagaaagtctgttttcaagatttgtgcttcaatttgtatgaggtagaactgtcaaacagacaaggggaaaatatagataaattaacagaatgtattaaaaacaagcaattggcaatcatcaaatgcttagaagatcgagggtttttcattttacttacatcatcagccttactatcagaaccagattttggaggcaagcagatgggtctgcatgggttacatttatttcgttcacccctgtcaacaggggtgaaagatttgaaagttgaagatgacatctcaatgaaggtgatacctattttatctacccttaattgtgccctgctagaaacaaagaaatcacttcctgaagaaagaatccatccaaacacattagtaaagcgtcatttccaagaattgtacaaggcggacagaagcccttcattgagtgttgctcctcaggatagaatgaaagaccctacattcttggggaaactgcccagtggttttgacttgattcctccagctgaaaagtgcccttcagagtctttaactcagttgaactcttatttttcagaccctagtgcttacattttggaagtgtctactgctttggacttgctagcagagcatcctcagtctccttgtgtttcagacggaatttgtgatgctggattttccttagttatgactccagatcctgaatttcttgtctcagaggcagaagtgagaaaagaaactgaaacaaaaaaggattctgaagaaatgttgaaagcaaagaagagagtttttccattgagtccagcgtcaaatctgagagtgcagcctaagaggaaggccagcatgccccacatggtgcagagtaaaaaggtgaacttgtgccgcccctttcccaaaagaactgcttccagagcagacaacagctcggactctccaacaactcttaagttagttaaaggacagtttcctcagaaaagaaaaagaggtgcggaagtgctgactgcacagtttgtacagaaaaccaaattggataggaaaaaccaagaagctcctatttctaaagatgttccagtgccaacaaatgctaaaagggcaaggaaacaagagaaatctccagtcaaaactgttccaagggctaagccacctgtgaagaaatctccacaaaaacagagagtaaatatagtaaaaggcaatgagaaccccagaaacagaaagcagctacaacctgtcaaaggagaaactgcttcaaagcttcaatcagaaatttcaagaggttgtcaagaagatgggattagcataaatagtgttcaaccagaaaataccacagcggctcacaatgatcttcctgaaaactccatcgtcaactatgactcccaggccctaaatatgttagccgatctagcattaagctctgctacttcttccacaccagtatctgaggctagaaatcttcactgttcctctgaattgccacaaaatgatgttttgctctctaaagaaaattctttgcgaggtacatctgaccatgaatatcatagaggagttaaaactcaaaaaggtgaattactacctaacccatcttctgataggaagagtaattctggatcagacttaacagttagccaagatgaagaaagcttggttccttgtagtcaggcccctgctaaagcccagtcagcacttactgaggaaatgctagaatcttcagatgcaagccaaagctcttctgtttctgtggaacattcatatgccctgctccttacagaacattcaaagaaacatctacaggagagagagatactaagccctctgtttcccaggaatgggacaaaaagccctgaagcagcaaccccagtggggaaagtcatgccatttcggcatcagcccggccttttgcttcagcaaaagcctcctgacgaccccgtggtgaagcccaaggatcgaccaccgtctgcccgtgtgaaaaaatcttcttgctctcgtatagtgcttagctgtgatgactccgttaagatcactttcaaatgtgaaacagaatatgcattcagtttagacagcaaatataccaacaacccactggagaaaactgtagtaagagcattacatgggccctggaatactgatttgcctgataatgtggaagaagtgaagcttttacttcatatgtgggtagctctgttttacagcaatcagaacaaaatcatacgatcttcccgaaaggttgtagaacacagcaacccagcaaaatatgtgtctataaatagcacgttagaatcttgtgagctccgtgaaattgaggagtcccttggtttggaaaaatgttctgcagactctctgttggagactaacgaaatttccagggctcatgctgctgaagtatccttccgtgatcctaactgcttgcttcctttcattaaaacaccacttacccaaggcttggaactctgtgtacaaaatgaacagaaaaaaacttttgcaagagagtgtgatccagacacccaagaagaccagaatttcatctgttcttacaataatgaggtaactggggaagaagctaaacaagaatcattggagacttctaatcttgtgctttcgggtattggaagtacacaaactaatggaccttctgttcctagtgaagaagaaattgttcagccactggatagcacaagagtggcttcttacagtggcactgttactcaagccacattcaccaggacttacgatgggcctggcagtcagccagtgatatgtcagagctctgtgtacggcacccttgaaaacaaagtggatattcttgatgcagcagtgcaaacaaaaacaggtactttacaggaccttatccaacatggcagccccataaacaatgaatgtcacccttccttggaaagaaaggatgataatatggggtgtgcagtgattaacccggaaccaattactctcacctttgaaaaaaatgcacatgtaccaatacagacagaaggtgtaaatactgctgatgaacctacaacctttataaacaaaagctcaaggtcctgaattttttagcacgtgaacagatcctgagactaaaaagtttgaaaac

SEQ ID NO: 2052 - DNA, 718 bp, synthetic construct; identical to SEQ ID NO: 1366
  misc_feature 1..718: note = Synthetic polypeptide
  source 1..718: mol_type = other DNA

SEQ ID NO: 2053 - DNA, 569 bp, synthetic construct; identical to SEQ ID NO: 426
  misc_feature 1..569: note = Synthetic polypeptide
  source 1..569: mol_type = other DNA

SEQ ID NO: 2054 - DNA, 4191 bp, synthetic construct
  misc_feature 1..4191: note = Synthetic polypeptide
  source 1..4191: mol_type = other DNA
atggcccgctggatcccgaccaagaggcagaagtacggggttgcgatctataactacaatgcttctcaagatgtggagctctccttgcagatcggtgacacagttcacatcctggagatgtacgagggttggtacagaggatataccctccaaaataaatctaaaaagggcattttccctgaaacatatatccatttgaaagaggcaactgtggaagacctggggcagcatgaaaccgtgattcctggcgagctccccctggtgcaggagctcacgtccactctgcgagaatgggctgtcatctggcgaaagctctacgtgaacaacaagctcaccctcttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcagtgagaactatctaattcgttggggcagtaacgggatgcccaaggaaatagagaagctcaataacctccaagcagtgtttacagaccttagcagcatggacctcatccggccccgcgtcagccttgtgtgccagattgtccgcgtgggccatatggagctgaaggaaggcaagaagcacacctgtggactccgaagaccttttggagtggcagtgatggatattactgatatcatacatgggaaggtggatgatgaagaaaagcagcattttattccctttcagcaaattgcgatggaaacctacatccgccagaggcagctcatcatgtcgcctttgataacatcacacgtgattggggagaatgagccactcacttcagtcttgaataaagtgattgcagcaaaggaagtgaatcacaaagggcaaggcctttgggtatccttgaagctcttgcccggtgacctcacccaggttcagaagaatttttcacacttggttgatagatcaacagcaatagcccggaagatgggctttcctgaaatcatactgccaggagatgttcggaatgacatttatgtcaccctgatccacggtgagtttgacaaagggaagaagaagacgccaaagaatgtggaggtgacgatgtctgtgcacgatgaggagggcaagctcttggagaaagcaattcaccctggtgctggatatgaaggcatttcagaatacaaatcagtagtctattaccaagtcaagcagccctgttggtatgagactgtcaaggtatccattgctatagaagaagtcacacgctgtcatataagatttaccttccgacacaggtcatctcaggaaaccagagataaatcggagcgagcatttggggtggccttcgtgaagctgatgaacccggatggcaccactctgcaggatgggaggcacgatctggtggtttataagggtgacaacaaaaaaatggaagatgctaaattctacctgaccctgcctggaaccaagatggagatggaagaaaaagagcttcaagcatccaaaaacctggtcaccttcaccccaagcaaggatagcactaaagacagctttcagattgccaccctcatctgctccacaaagctcacccagaatgttgacctgttaggcttgttaaattggcgttccaactcccagaacattaaacacaacctaaagaagttaatggaagtggatggaggagagattgttaagtttttgcaagatacactagatgcactctttaacataatgatggaaatgtcagacagtgaaacctatgacttccttgtgtttgacgcactggtatttattatttcactgataggagacatcaagttccagcattttaatcctgtacttgaaacctacatttacaagcacttcagcgccactttggcatatgtgaaactctccaaggtactgaacttctatgtggctaatgcagatgactccagcaagactgaactgctttttgctgcgttgaaagccttgaagtacttgtttagattcatcatccaatcccgagtgctctacttgagattttatgggcagagcaaagatggagatgagtttaataattcaattcgccagttatttcttgctttcaatatgctgatggacaggcctctggaggaagccgtcaagatcaagggggcagctttgaagtaccttcctagcataattaatgatgtcaaacttgtatttgatcctgttgagctcagcgtgctcttctgcaaattcattcaaagcattcctgacaaccagctggttcggcagaaacttaactgcatgaccaagatagtagagagcactctttttcgacagtcagagtgcagagaagtgctgctgccactgctgacagaccagctcagcggccagttagatgacaactccaacaagcctgaccacgaggcaagctcgcagcttctgagcaacatcctggaggtgctggacaggaaggatgtgggtgccactgcggtgcacattcagcttataatggaacggctgctgagaaggatcaaccggacagtgattgggatgaaccggcagtctccccacatcgggagttttgtggcttgcatgattgccctgctgcagcaaatggacgacagccactatagccactacatcagcactttcaaaaccagacaagacatcatcgacttcctcatggaaacttttatcatgttcaaggacctgattggaaagaatgtctatgccaaagattggatggtgatgaatatgactcaaaacagggtttttctccgtgctataaatcagtttgctgaagttctcacaagattcttcatggatcaggcaagctttgaacttcagctctggaacaattacttccatttggcagttgcatttctcacccatgagtcccttcagcttgaaaccttctcacaagccaagcgcaacaaaattgttaaaaaatatggggacatgagaaaggaaatcggctttagaatccgggacatgtggtataacctgggtccccacaaaatcaaattcatcccatccatggtgggtcccattctggaggtcactctgacccctgaagtagagctccggaaagccacaatccccattttctttgatatgatgcagtgtgagttcaatttcagtggaaatggcaatttccatatgtttgagaatgagctgatcacaaagctggaccaggaggtagaagggggcagaggagacgaacaatacaaggttcttctggaaaaactgctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctgaacttttataaagaaaagaagagagaggacatatacataagatatctgtacaagcttcgagatttgcaccgagactgtgagaactacacagaagctgcctacacgcttctcttgcacgctgagcttctgcagtggtctgacaagccctgtgtgcctcatttgcttcagaaggacagttactatgtttatacccagcaagagcttaaagagaagctgtatcaagaaatcatatcatatttcgacaaaggcaaaatgtgggagaaggccatcaagctgagcaaagagttggctgagacttacgaaagcaaagtatttgactacgagggccttggcaacctcctgaaaaaaagggcctcattttatgagaacatcattaaggcaatgaggcctcagcctgaatactttgctgttggatactatggacagggctttccttctttcctacggatgggtccagactgtttgcagactggccatggtccttgggccacactggaagaagaactg

SEQ ID NO: 2055 - DNA, 1770 bp, synthetic construct
  misc_feature 1..1770: note = Synthetic polypeptide
  source 1..1770: mol_type = other DNA
atggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggatgtcagctccagatgggcatttttgtcgtttctcttgactgctgtatcctcagtatataaaacagtgcatagcaggtgctgaacaaatatt

SEQ ID NO: 2056 - DNA, 1465 bp, synthetic construct
  misc_feature 1..1465: note = Synthetic polypeptide
  source 1..1465: mol_type = other DNA
ggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggatgtcagctccagatgggcatttttgtcgtttctcttgactgctgtatcctcagtatataaaacagtgcatagcaggtgctgaacaaatatt

SEQ ID NO: 2057 - DNA, 1470 bp, synthetic construct; identical to SEQ ID NO: 1592
  misc_feature 1..1470: note = Synthetic polypeptide
  source 1..1470: mol_type = other DNA

SEQ ID NO: 2058 - DNA, 202 bp, synthetic construct; identical to SEQ ID NO: 1593
  misc_feature 1..202: note = Synthetic polypeptide
  source 1..202: mol_type = other DNA

SEQ ID NO: 2059 - DNA, 128 bp, synthetic construct; identical to SEQ ID NO: 1082
  misc_feature 1..128: note = Synthetic polypeptide
  source 1..128: mol_type = other DNA

SEQ ID NO: 2060 - DNA, 679 bp, synthetic construct; identical to SEQ ID NO: 1729
  misc_feature 1..679: note = Synthetic polypeptide
  source 1..679: mol_type = other DNA

SEQ ID NO: 2061 - DNA, 3825 bp, synthetic construct; identical to SEQ ID NO: 158
  misc_feature 1..3825: note = Synthetic polypeptide
  source 1..3825: mol_type = other DNA

SEQ ID NO: 2062 - DNA, 939 bp, synthetic construct
  misc_feature 1..939: note = Synthetic polypeptide
  source 1..939: mol_type = other DNA
atgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgagggattcctccagggattggagagagagaaatgtggaatgcagaaatgtacatgtaggatattgatttcacttatgtgaaataaa

SEQ ID NO: 2063 - DNA, 1416 bp, synthetic construct
  misc_feature 1..1416: note = Synthetic polypeptide
  source 1..1416: mol_type = other DNA
atggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgagggattcctccagggattggagagagagaaatgtggaatgcagaaatgtacatgtaggatattgatttcacttatgtgaaataaa

SEQ ID NO: 2064 - DNA, 324 bp, synthetic construct
  misc_feature 1..324: note = Synthetic polypeptide
  source 1..324: mol_type = other DNA
atgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgagggattcctccagggattggagagagagaaatgtggaatgcagaaatgtacatgtaggatattgatttcacttatgtgaaataaa

SEQ ID NO: 2065 - DNA, 652 bp, synthetic construct
  misc_feature 1..652: note = Synthetic polypeptide
  source 1..652: mol_type = other DNA
atgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggaggcacggtggctcacgcctgtaatcccagcactttgggaggccgagacgggcggatcacgaggtcaagagatggagaccatcccggctaacacggtgaaaccccgtctctactaaaaatacaaaaaattagccgggcgtagtggccggcgcctgtagtcccagctactggggaggctgaggcaggagaatggcctgaacccgagaggtggagcttgcagtgagctgagatcacggcactgcactccagcctgggcgacagagcgagactccatctcgagcaaacaaacaaaaa

SEQ ID NO: 2066 - DNA, 1119 bp, synthetic construct
  misc_feature 1..1119: note = Synthetic polypeptide
  source 1..1119: mol_type = other DNA
atggaggatttcatcgtgatctcggacgacagcggctctgagagctccgggggcgcccgcccgggccggtcgcggaggccgcgccgggccctgtcgcgaacctccggcgcgctgccccgccggaccgtgaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatccatctaggaagtgaggagcgtctctgcccggctgcccattgtctgagatgtggggagcgcctctgccccgccgccccatctgggatgtgaggagcgcctctgcctggccgagaccccgtctgggaggtgacgagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtggggggtcagccccgacgcccggccagccgtgccatccaggagggggggggggtcagccccccgcctggccagccgtgccgtccgggagggaggtggggggtcagccccccgcccggccagccgccccgtctgggaggtgaggggc

SEQ ID NO: 2067 - DNA, 2364 bp, synthetic construct
  misc_feature 1..2364: note = Synthetic polypeptide
  source 1..2364: mol_type = other DNA
atggcaccagcatctgcttctggtgaggacctcaggaagcttccaaccatggcagaggtgaatggggagcaggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattacatccacaagatgtggcatacctgcaagacatgccacggtcaccaggagatgtgccacagtcaccaagtgatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaaccgtgacatgcctatggatatctcagctctgtcctctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgtcctccggttcatcacctcttctttcagacgctaataccggataaagacacaagagagaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatccatctaggaagtgaggagcgtctctgcccggctgcccattgtctgagatgtggggagcgcctctgccccgccgccccatctgggatgtgaggagcgcctctgcctggccgagaccccgtctgggaggtgacgagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtggggggtcagccccgacgcccggccagccgtgccatccaggagggggggggggtcagccccccgcctggccagccgtgccgtccgggagggaggtggggggtcagccccccgcccggccagccgccccgtctgggaggtgaggggc

SEQ ID NO: 2068 - DNA, 2421 bp, synthetic construct
  misc_feature 1..2421: note = Synthetic polypeptide
  source 1..2421: mol_type = other DNA
atggaggatttcatcgtgatctcggacgacagcggctctgagagctccgggggcgcccgcccgggccggtcgcggaggccgcgccgggccctgtcgcgaacctccggcgcgctgccccgccggaccgtggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattacatccacaagatgtggcatacctgcaagacatgccacggtcaccaggagatgtgccacagtcaccaagtgatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaaccgtgacatgcctatggatatctcagctctgtcctctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgtcctccggttcatcacctcttctttcagacgctaataccggataaagacacaagagagaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatccatctaggaagtgaggagcgtctctgcccggctgcccattgtctgagatgtggggagcgcctctgccccgccgccccatctgggatgtgaggagcgcctctgcctggccgagaccccgtctgggaggtgacgagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtggggggtcagccccgacgcccggccagccgtgccatccaggagggggggggggtcagccccccgcctggccagccgtgccgtccgggagggaggtggggggtcagccccccgcccggccagccgccccgtctgggaggtgaggggc

SEQ ID NO: 2069 - DNA, 4277 bp, synthetic construct
  misc_feature 1..4277: note = Synthetic polypeptide
  source 1..4277: mol_type = other DNA
atggtggctgcagcggcggcaactgaggcaaggctgaggaggaggacggcggcgacggcagcgctcgcgggcaggagcggcgggccgcactgggactgggacgtgaccagggctgggaggccggggctgggggccgggctgcgcctcccgcggctgctgtctccaccgctgcggccacggctgctgctgctgctgttgttgctctcgccgccgctgctgctgctgctgctgccctgtgaggccgaggccgcggcggcggcggcggcggtgtcgggctcagccgcagccgaggccaaggaatgtgaccggccctgtgtcaacggcggtcgctgcaaccctggcaccggccagtgcgtctgccccgccggctgggtgggcgagcaatgccagcactgcgggggccgcttcagactaactggatcttctgggtttgtgacagatggacctggaaattataaatacaaaacgaagtgcacgtggctcattgaaggacagccaaatagaataatgagacttcgtttcaatcattttgctacagagtgtagttgggaccatttatatgtttatgatggggactcaatttatgcaccgctagttgctgcatttagtggcctcattgttcctgagagagatggcaatgagactgtccctgaggttgttgccacatcaggttatgccttgctgcatttttttagtgatgctgcttataatttgactggatttaatattacttacagttttgatatgtgtccaaataactgctcaggccgaggagagtgtaagatcagtaatagcagcgatactgttgaatgtgaatgttctgaaaactggaaaggtgaagcatgtgacattcctcactgtacagacaactgtggttttcctcatcgaggcatctgcaattcaagtgatgtcagaggatgctcctgcttctcagactggcagggtcctggatgttcagttcctgtaccagctaaccagtcattttggactcgagaggaatattctaacttaaagctccccagagcatctcataaagctgtggtcaatggaaacattatgtgggttgttggaggatatatgttcaaccactcagattataacatggttctagcgtatgaccttgcttctagggagtggcttccactaaaccgttctgtgaacaatgtggttgttagatatggtcattctttggcattatacaaggataaaatttacatgtatggaggaaaaattgattcaactgggaatgtgaccaatgagttgagagtttttcacattcataatgagtcatgggtgttgttgacccctaaggcaaaggagcagtatgcagtggttgggcactctgcacacattgttacactgaagaatggccgagtggtcatgctggtcatctttggtcactgccctctctatggatatataagcaatgtgcaggaatatgatttggataagaacacatggagtatattacacacccagggtgcccttgtgcaagggggttacggccatagcagtgtttacgaccataggaccagggccctatacgttcatggtggctacaaggctttcagtgccaataagtaccggcttgcagatgatctctaccgatatgatgtggatacccagatgtggaccattcttaaggacagccgatttttccgttacttgcacacagctgtgatagtgagtggaaccatgctggtgtttggaggaaacacacacaatgacacatctatgagccatggcgccaaatgcttctcttcagatttcatggcctatgacattgcctgtgaccgctggtcagtgcttcccagacctgatctccaccatgatgtcaacagatttggccattcagcagtcttacacaacagcaccatgtatgtgttcggtggtttcaatagtctcctcctcagcgacatcctggtattcacctcggaacagtgtgatgcgcatcggagtgaagccgcttgtttagcagcaggacctggtattcggtgtgtgtggaacacagggtcgtctcagtgtatctcgtgggcgctggcaactgatgaacaagaagaaaagttaaaatcagaatgtttttccaaaagaactcttgaccatgacagatgtgaccagcacacagattgttacagctgcacagccaacaccaatgactgccactggtgcaatgaccattgtgtccccaggaaccacagctgctcagaaggccagatctccatttttaggtatgagaattgccccaaggataaccccatgtactactgtaacaagaagaccagctgcaggagctgtgccctggaccagaactgccagtgggagccccggaatcaggagtgcattgccctgcccgaaaatatctgtggcattggctggcatttggttggaaactcatgtttgaaaattactactgccaaggagaattatgacaatgctaaattgttctgtaggaaccacaatgcccttttggcttctcttacaacccagaagaaggtagaatttgtccttaagcagctgcgaataatgcagtcatctcagagcatgtccaagctcaccttaaccccatgggtcggccttcggaagatcaatgtgtcctactggtgctgggaagatatgtccccatttacaaatagtttactacagtggatgccgtctgagcccagtgatgctggattctgtggaattttatcagaacccagtactcggggactgaaggctgcaacctgcatcaacccactcaatggtagtgtctgtgaaaggcctgcaaaccacagtgctaagcagtgccggacaccatgtgccttgaggacagcatgtggagattgcaccagcggcagctctgagtgcatgtggtgcagcaacatgaagcagtgtgtggactccaatgcctacgtggcctccttcccttttggccagtgtatggaatggtatacgatgagcacctgcccccctgaaaattgttcaggctactgtacctgtagtcattgcttggagcaaccaggctgtggctggtgtactgatcccagcaatactggcaaagggaaatgcatagagggttcctataaaggaccagtgaagatgccttcgcaagcccctacaggaaatttctatccacagcccctgctcaattccagcatgtgtctagaggacagcagatacaactggtctttcattcactgtccagcttgccaatgcaacggccacagtaaatgcatcaatcagagcatctgtgagaagtgtgagaacctgaccacaggcaagcactgcgagacctgcatatctggcttctacggtgatcccaccaatggagggaaatgtcagccatgcaagtgcaatgggcacgcgtctctgtgcaacaccaacacgggcaagtgcttctgcaccaccaagggcgtcaagggggacgagtgccagctatgtgaggtagaaaatcgataccaaggaaaccctctcagaggaacatgttattatactcttcttattgactatcagttcacctttagtctatcccaggaagatgatcgctattacacagctatcaattttgtggctactcctgacgaacaaaacagggatttggacatgttcatcaatgcctccaagaatttcaacctcaacatcacctgggctgccagtttctcagctggaacccaggctggagaagagatgcctgttgtttcaaaaaccaacattaaggagtacaaagatagtttctctaatgagaagtttgattttcgcaaccacccaaatatcactttctttgtttatgtcagtaatttcacctggcccatcaaaattcagattgccttctctcagcacagcaattttatggacctggtacagttcttcgtgactttcttcagttgtttcctctctttgctcctggtggctgctgtggtttggaagatcaaacaaagttgttgggcctccagacgtagagagcaacctggatggaattggagaccgttattctaagtgaaataattcaggaatggaaaaccacacttcatatattctcacttacaagtgggaactaagccctgaggatgcaaaggcataagaatgatacagtggattttgaggactcgggggaaagagtgggagggggatgagggataaaatactatacatcgggtacagtgtacactgctcgggtgataggtgcaccagaatctcagaaatcaccatgaaagaacttattcatgtaaccaaacaccacctgttcccccaaaaacctattgaaataataaataaataaataaataaataaataaata

SEQ ID NO: 2070 - DNA, 2080 bp, synthetic construct
  misc_feature 1..2080: note = Synthetic polypeptide
  source 1..2080: mol_type = other DNA
atgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttggacataaagtacatcgaggtgacctccgccagatcaaggtgccacgatggcccccagcactgctccagcccctctgtcaccccgcccttcggctcccttcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctgcagtcaccatcatccagaccccccgggcctcagtttcctcaatcatagaagaagaccaatagacaagatcagct

SEQ ID NO: 2071 - DNA, 170 bp, synthetic construct
  misc_feature 1..170: note = Synthetic polypeptide
  source 1..170: mol_type = other DNA
ggtgtttttccggcgccattacccactcaccaccctccgcttctgtggtatggaccctgagcaacggaagtggcagaagtactgcaaaccctcctgcagtcaccatcatccagaccccccgggcctcagtttcctcaatcatagaagaagaccaatagacaagatcagct

SEQ ID NO: 2072 - DNA, 410 bp, synthetic construct
  misc_feature 1..410: note = Synthetic polypeptide
  source 1..410: mol_type = other DNA
atggatggccgagacttcgggccccagcggtccgtgcacggtcccccgccgccgctgctgtccggcctggccatggacagccaccgcgtgggcgcggccactgccggacgcttgcccgcctcgggcttgcccggcccgctgccgcccgggaagtacatggccggcctgaatctccatccgcacccgggcgaggccttcttgggcagctttgtggccagcgggatggggccctcggcctcgtcccatgggagcccagtgccactgccctctgacctgtctttccgctccccaacccctagcaacctgcccatggtgcagctgtgggccgcccacgcccatgaagcctgacaccccatgccacagaccaccttccagtcctcctccggctcagctcagagaccccctcttcc

SEQ ID NO: 2073 - DNA, 188 bp, synthetic construct
  misc_feature 1..188: note = Synthetic polypeptide
  source 1..188: mol_type = other DNA
atggggccctcggcctcgtcccatgggagcccagtgccactgccctctgacctgtctttccgctccccaacccctagcaacctgcccatggtgcagctgtgggccgcccacgcccatgaagcctgacaccccatgccacagaccaccttccagtcctcctccggctcagctcagagaccccctcttcc

SEQ ID NO: 2074 - DNA, 47 bp, synthetic construct
  misc_feature 1..47: note = Synthetic polypeptide
  source 1..47: mol_type = other DNA
atggaggacggcgtgctcaaggagggcttcctggtcaagaggtttct

SEQ ID NO: 2075 - DNA, 649 bp, synthetic construct
  misc_feature 1..649: note = Synthetic polypeptide
  source 1..649: mol_type = other DNA
atgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtcactggtaccccagaccatgccacacctttattatgtgctctccattccccaccaaccgtgctcacctcagttgtgaattacatgttcatttctgcaggtctattttatcccataactgtccatcaagataagggcttgctcattactttacccccagcactcagcccaatgcctggcacatagtaggtgctcaataaa

SEQ ID NO: 2076 - DNA, 2153 bp, synthetic construct; identical to SEQ ID NO: 217
  misc_feature 1..2153: note = Synthetic polypeptide
  source 1..2153: mol_type = other DNA

SEQ ID NO: 2077 - DNA, 1664 bp, synthetic construct; identical to SEQ ID NO: 222
  misc_feature 1..1664: note = Synthetic polypeptide
  source 1..1664: mol_type = other DNA

SEQ ID NO: 2078 - DNA, 1766 bp, synthetic construct; identical to SEQ ID NO: 221
  misc_feature 1..1766: note = Synthetic polypeptide
  source 1..1766: mol_type = other DNA

SEQ ID NO: 2079 - DNA, 2192 bp, synthetic construct
  misc_feature 1..2192: note = Synthetic polypeptide
  source 1..2192: mol_type = other DNA
atgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaaggaaaagaggaagtcaaattgtccctgtttgcagacgacatgattgtttatctagaaaaccccatcgtctcagcccaaaatctccttaagctgataagcaacttcagcaaagtctcaggatacaaaatcagtgtacaaaaatcacaagcattcttatacaccaacaacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctagaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcacaacctactcatctgacaaagggctaatatccagaatctacaatgaactcaaatttacaagaaaaaaacaaacaaccccatcaaaaagtgggcgaaggacatgaacagacacttctcaaaagaagacatttatgcagccaaaaaacacatgaaaaaatgttcatcatcactggtcatcagagaaatgcaaatcaaaaccactatgagatatcatctcacacc

SEQ ID NO: 2080 - DNA, 1430 bp, synthetic construct
  misc_feature 1..1430: note = Synthetic polypeptide
  source 1..1430: mol_type = other DNA
atgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagatggtgtgacaatcattcagaaaatgtacaaagaagagttcggtaacctgaaatgttttatagttgggaggatttattgt

SEQ ID NO: 2081 - DNA, 1175 bp, synthetic construct
  misc_feature 1..1175: note = Synthetic polypeptide
  source 1..1175: mol_type = other DNA
atgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagatggtgtgacaatcattcagaaaatgtacaaagaagagttcggtaacctgaaatgttttatagttgggaggatttattgt

SEQ ID NO: 2082 - DNA, 1418 bp, synthetic construct
  misc_feature 1..1418: note = Synthetic polypeptide
  source 1..1418: mol_type = other DNA
atgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatgcgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagatggtgtgacaatcattcagaaaatgtacaaagaagagttcggtaacctgaaatgttttatagttgggaggatttattgt

SEQ ID NO: 2083 - DNA, 1148 bp, synthetic construct
  misc_feature 1..1148: note = Synthetic polypeptide
  source 1..1148: mol_type = other DNA
atgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagatggtgtgacaatcattcagaaaatgtacaaagaagagttcggtaacctgaaatgttttatagttgggaggatttattgt

SEQ ID NO: 2084 - DNA, 893 bp, synthetic construct
  misc_feature 1..893: note = Synthetic polypeptide
  source 1..893: mol_type = other DNA
atgttgtacctggaaaacaatgcccagactcaatttagtgagtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagatggtgtgacaatcattcagaaaatgtacaaagaagagttcggtaacctgaaatgttttatagttgggaggatttattgt

SEQ ID NO: 2085 - DNA, 1136 bp, synthetic construct
  misc_feature 1..1136: note = Synthetic polypeptide
  source 1..1136: mol_type = other DNA
atgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatgcgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagatggtgtgacaatcattcagaaaatgtacaaagaagagttcggtaacctgaaatgttttatagttgggaggatttattgt

SEQ ID NO: 2086 - DNA, 1692 bp, synthetic construct; identical to SEQ ID NO: 1048
  misc_feature 1..1692: note = Synthetic polypeptide
  source 1..1692: mol_type = other DNA

SEQ ID NO: 2087 - DNA, 1695 bp, synthetic construct; identical to SEQ ID NO: 1049
  misc_feature 1..1695: note = Synthetic polypeptide
  source 1..1695: mol_type = other DNA

SEQ ID NO: 2088 - DNA, 466 bp, synthetic construct; identical to SEQ ID NO: 1050
  misc_feature 1..466: note = Synthetic polypeptide
  source 1..466: mol_type = other DNA

SEQ ID NO: 2089 - DNA, 2474 bp, synthetic construct; identical to SEQ ID NO: 1065
  misc_feature 1..2474: note = Synthetic polypeptide
  source 1..2474: mol_type = other DNA

SEQ ID NO: 2090 - DNA, 1694 bp, synthetic construct; identical to SEQ ID NO: 1066
  misc_feature 1..1694: note = Synthetic polypeptide
  source 1..1694: mol_type = other DNA

SEQ ID NO: 2091 - DNA, 1361 bp, synthetic construct; identical to SEQ ID NO: 1067
  misc_feature 1..1361: note = Synthetic polypeptide
  source 1..1361: mol_type = other DNA

SEQ ID NO: 2092 - DNA, 688 bp, synthetic construct; identical to SEQ ID NO: 1068
  misc_feature 1..688: note = Synthetic polypeptide
  source 1..688: mol_type = other DNA

SEQ ID NO: 2093 - DNA, 531 bp, synthetic construct; identical to SEQ ID NO: 1069
  misc_feature 1..531: note = Synthetic polypeptide
  source 1..531: mol_type = other DNA

SEQ ID NO: 2094 - DNA, 2055 bp, synthetic construct
  misc_feature 1..2055: note = Synthetic polypeptide
  source 1..2055: mol_type = other DNA
atggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgttctccaccgacagccaggaaagaggaatgtcagccccgcaactacaaagaatgaaatctggccaacaacctggatgagcttggaagtggattcatccctagagcctccagaaagaaatgcagccctgccgacctgattgtggccttgggagatcctaatcaggggaccccgtgagccactctgtaccaggacttctgacctacagaaccgcgagagaataaattgctgttgttttaagcttctaaattgtggtgacttattatggtagcaatcaaaaatggataca

SEQ ID NO: 2095 - DNA, 2095 bp, synthetic construct
  misc_feature 1..2095: note = Synthetic polypeptide
  source 1..2095: mol_type = other DNA
atgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagaga

SEQ ID NO: 2096 - DNA, 1823 bp, synthetic construct
  misc_feature 1..1823: note = Synthetic polypeptide
  source 1..1823: mol_type = other DNA
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaattgccaaagatgaaaaaatatctgacaaaatcaagtgttgaaagaaagtgcaactttgctgttgggattttaaattgaaacaatggctctggaaaacaatctggcatcatctggtgaaactgaagatgcacatgcctaggatccagcaatctcactcctaggtaggtaacgccccagagaaacccttgcaacatgtgttccaggggacacacataagaatactcagagcagtaggaggaataacccaaatgtccatcaacagcagaatgggtaaatcggttgtgatatgcaatggaatg

SEQ ID NO: 2097 - DNA, 1859 bp, synthetic construct
  misc_feature 1..1859: note = Synthetic polypeptide
  source 1..1859: mol_type = other DNA
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaattgccaaagatgaaaaaatatctgacaaaatcaagtgttgaaagaaagtgcaactttgctgttgggattttaaattgaaacaatggctctggaaaacaatctggcatcatctggtgaaactgaagatgcacatgcctaggatccagcaatctcactcctaggtaggtaacgccccagagaaacccttgcaacatgtgttccaggggacacacataagaatactcagagcagtaggaggaataacccaaatgtccatcaacagcagaatgggtaaatcggttgtgatatgcaatggaatg

SEQ ID NO: 2098 - DNA, 1526 bp, synthetic construct
  misc_feature 1..1526: note = Synthetic polypeptide
  source 1..1526: mol_type = other DNA
atggaatgtctctactatttcctgggatttctgctcctggctgcaagattgccacttgatgccgccaaacaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaattgccaaagatgaaaaaatatctgacaaaatcaagtgttgaaagaaagtgcaactttgctgttgggattttaaattgaaacaatggctctggaaaacaatctggcatcatctggtgaaactgaagatgcacatgcctaggatccagcaatctcactcctaggtaggtaacgccccagagaaacccttgcaacatgtgttccaggggacacacataagaatactcagagcagtaggaggaataacccaaatgtccatcaacagcagaatgggtaaatcggttgtgatatgcaatggaatg

SEQ ID NO: 2099 - DNA, 1685 bp, synthetic construct
  misc_feature 1..1685: note = Synthetic polypeptide
  source 1..1685: mol_type = other DNA
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaattgccaaagatgaaaaaatatctgacaaaatcaagtgttgaaagaaagtgcaactttgctgttgggattttaaattgaaacaatggctctggaaaacaatctggcatcatctggtgaaactgaagatgcacatgcctaggatccagcaatctcactcctaggtaggtaacgccccagagaaacccttgcaacatgtgttccaggggacacacataagaatactcagagcagtaggaggaataacccaaatgtccatcaacagcagaatgggtaaatcggttgtgatatgcaatggaatg

SEQ ID NO: 2100 - DNA, 212 bp, synthetic construct
  misc_feature 1..212: note = Synthetic polypeptide
  source 1..212: mol_type = other DNA
atggatacatactgaaatgtggatgaagtgataggtcaggaatttgcttcaaggatctgggagaggcagaagcatagatatgaatggctgctagttgatcattgaatctggatggttagtgtatgagattcattttatttactgttttgtctacttttgtgtatatttgaaattttccatgataaaatgttaaaataacaaatacaatgtgt

SEQ ID NO: 2101 - DNA, 938 bp, synthetic construct
  misc_feature 1..938: note = Synthetic polypeptide
  source 1..938: mol_type = other DNA
atggccgtatacagggcagcgctcggggcttcgctcgcggctgcccgactcttgcccctcggtcgctgttccccgtcgccggcgccccgctctacgttgtcgggcgccgccatggagcccgcgcctcgctggctggcggggctgcgcttcgacaaccgcgccctgcgcgccctgcccgtggaggcgccgccgcccggtcccgagggcgccccgtccgcgccgcggcccgtgcccggggcctgcttcacccgcgtgcagcccaccccgctgcggcagccgcgcctcgtggcgctgtcagagcccgcgctggcgttgctgggcctgggcgcgccgcccgcgcgcgaggccgaggccgaggccgcgctgttcttcagcggcaacgcgctcctgccgggcgccgagcccgccgcgcactgctactgcggccaccaattcggccagttcgccgggcagctgggcgacggcgccgccatgtacctgggcgaggtgtgcacggcgaccggcgagcgctgggagctgcagctcaagggcgccgggcccacgcccttctccagaaagaagatgctgatatgctacaacacggatgaacctggaggacgtggtgcagtgaaataagctggtcacagagagacaaatcctgggtgatcccacttacatgaggtacctagagagccacattcatagagacaaagtagaatggtgggtcccaggggctggagggagtagaggaatcgggagccagtgttcgatggggacaaagtttcagtttctgggtcccaggggctggagggagtagaggaatcgggagccagtgttcgatggggacaaagtttcagtttcacaagacagatttctggacatggatgggggtgatggttgtgcaacattatgaacgtatttaatagcactgatctgtacacttataaatggctaagatg

SEQ ID NO: 2102 - DNA, 550 bp, synthetic construct
  misc_feature 1..550: note = Synthetic polypeptide
  source 1..550: mol_type = other DNA
atgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtcactggtaccccagaccatgccacacctttattatgtgctctccattccccaccaaccgtgctcacctcagttgtgaattacatgttcatttctgcaggtctattttatcccataactgtccatcaagataagggcttgctcattactttacccccagcactcagcccaatgcctggcacatagtaggtgctcaataaa

SEQ ID NO: 2103 - DNA, 505 bp, synthetic construct
  misc_feature 1..505: note = Synthetic polypeptide
  source 1..505: mol_type = other DNA
ggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtcactggtaccccagaccatgccacacctttattatgtgctctccattccccaccaaccgtgctcacctcagttgtgaattacatgttcatttctgcaggtctattttatcccataactgtccatcaagataagggcttgctcattactttacccccagcactcagcccaatgcctggcacatagtaggtgctcaataaa

SEQ ID NO: 2104 - DNA, 1032 bp, synthetic construct; identical to SEQ ID NO: 1790
  misc_feature 1..1032: note = Synthetic polypeptide
  source 1..1032: mol_type = other DNA

SEQ ID NO: 2105 - DNA, 289 bp, synthetic construct; identical to SEQ ID NO: 1791
  misc_feature 1..289: note = Synthetic polypeptide
  source 1..289: mol_type = other DNA

SEQ ID NO: 2106 - DNA, 1314 bp, synthetic construct; identical to SEQ ID NO: 1792
  misc_feature 1..1314: note = Synthetic polypeptide
  source 1..1314: mol_type = other DNA

SEQ ID NO: 2107 - DNA, 620 bp, synthetic construct; identical to SEQ ID NO: 1793
  misc_feature 1..620: note = Synthetic polypeptide
  source 1..620: mol_type = other DNA

SEQ ID NO: 2108 - DNA, 1736 bp, synthetic construct; identical to SEQ ID NO: 156
  misc_feature 1..1736: note = Synthetic polypeptide
  source 1..1736: mol_type = other DNA

SEQ ID NO: 2109 - DNA, 1724 bp, synthetic construct; identical to SEQ ID NO: 157
  misc_feature 1..1724: note = Synthetic polypeptide
  source 1..1724: mol_type = other DNA

SEQ ID NO: 2110 - DNA, 809 bp, synthetic construct
  misc_feature 1..809: note = Synthetic polypeptide
  source 1..809: mol_type = other DNA
atgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagaatgtaagttccataaaggtaagaaccttctgttcttgtccaccaaggcctagaaaggtgggacacagagtaggcacttaaatattgattggctgaa

SEQ ID NO: 2111 - DNA, 644 bp, synthetic construct
  misc_feature 1..644: note = Synthetic polypeptide
  source 1..644: mol_type = other DNA
atgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagaatgtaagttccataaaggtaagaaccttctgttcttgtccaccaaggcctagaaaggtgggacacagagtaggcacttaaatattgattggctgaa

SEQ ID NO: 2112 - DNA, 768 bp, synthetic construct
  misc_feature 1..768: note = Synthetic polypeptide
  source 1..768: mol_type = other DNA
atgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagaatgtaagttccataaaggtaagaaccttctgttcttgtccaccaaggcctagaaaggtgggacacagagtaggcacttaaatattgattggctgaa

SEQ ID NO: 2113 - DNA, 427 bp, synthetic construct
  misc_feature 1..427: note = Synthetic polypeptide
  source 1..427: mol_type = other DNA
ggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagaatgtaagttccataaaggtaagaaccttctgttcttgtccaccaaggcctagaaaggtgggacacagagtaggcacttaaatattgattggctgaa

SEQ ID NO: 2114 - DNA, 1026 bp, synthetic construct
  misc_feature 1..1026: note = Synthetic polypeptide
  source 1..1026: mol_type = other DNA
atgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaa

SEQ ID NO: 2115 - DNA, 721 bp, synthetic construct; identical to SEQ ID NO: 414
  misc_feature 1..721: note = Synthetic polypeptide
  source 1..721: mol_type = other DNA

SEQ ID NO: 2116 - DNA, 627 bp, synthetic construct
  misc_feature 1..627: note = Synthetic polypeptide
  source 1..627: mol_type = other DNA
atgaccacctgcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctgcgggctggggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaaccaggtttcagaaccgctg

SEQ ID NO: 2117 - DNA, 3723 bp, synthetic construct; identical to SEQ ID NO: 1743
  misc_feature 1..3723: note = Synthetic polypeptide
  source 1..3723: mol_type = other DNA

SEQ ID NO: 2118 - DNA, 3708 bp, synthetic construct; identical to SEQ ID NO: 1744
  misc_feature 1..3708: note = Synthetic polypeptide
  source 1..3708: mol_type = other DNA

SEQ ID NO: 2119 - DNA, 3333 bp, synthetic construct; identical to SEQ ID NO: 1745
  misc_feature 1..3333: note = Synthetic polypeptide
  source 1..3333: mol_type = other DNA

SEQ ID NO: 2120 - DNA, 335 bp, synthetic construct
  misc_feature 1..335: note = Synthetic polypeptide
  source 1..335: mol_type = other DNA
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagggaacctggggaaaaatcagaaagaacctagagtgag

SEQ ID NO: 2121 - DNA, 578 bp, synthetic construct
  misc_feature 1..578: note = Synthetic polypeptide
  source 1..578: mol_type = other DNA
atggcctggtggaaatcctggattgaacaggagggtgtcacagtgaagagcagctcccacttcaacccagaccctgatgcagagaccctctacaaagccatgaaggggatcggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcagcagggatgatgtgagcagctttgtggacccaggactggccctccaagacgcacaggttatacagaccccagccccattcccatctactgaaacagggtctccacaagaggggccagggaatatgggtttttaacaagc

SEQ ID NO: 2122 - DNA, 635 bp, synthetic construct
  misc_feature 1..635: note = Synthetic polypeptide
  source 1..635: mol_type = other DNA
atggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggttatacagaccccagccccattcccatctactgaaacagggtctccacaagaggggccagggaatatgggtttttaacaagc

SEQ ID NO: 2123 - DNA, 449 bp, synthetic construct
  misc_feature 1..449: note = Synthetic polypeptide
  source 1..449: mol_type = other DNA
atggcctggtggaaatcctgggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggttatacagaccccagccccattcccatctactgaaacagggtctccacaagaggggccagggaatatgggtttttaacaagc

SEQ ID NO: 2124 - DNA, 1714 bp, synthetic construct
  misc_feature 1..1714: note = Synthetic polypeptide
  source 1..1714: mol_type = other DNA
atgcccgggatcgtggtgttccggcggcgctggtctgtgggcagtgatgacctcgtcctaccggccatcttcctctttctcctgcataccacctggtttgtgatcctgtccgtggtgctcttcggcctggtctataacccgcacgaggcctgctccctgaacctggtggaccacggccgcggctacctgggcatcctgctgagctgcatgatcgctgagatggccatcatctggctgagcatgcgcgggggcatcctctacacggagccccgtgactccatgcagtacgtgctctacgtgcgcctggccatcctggtgatcgagttcatctacgccatcgtgggcatcgtctggctcactcagtactacacctcctgcaacgacctcactgccaagaatgtcaccctcggaatggttgtctgcaactgggtagtcatcctcagtgtgtgcatcactgtcctctgcgtcttcgaccccacgggccgcacctttgtcaagctgagagccaccaagaggaggcagcgtaacctgcggacctacaacctgcggcaccgcttagaggagggtcaagccaccagctggtcgcgccggctcaaagtgttcctctgctgcacgcggacgaaggactcccagtcagatgcctactcagaaatcgcctacctctttgcggagttcttccgggaccttgacattgtgccatccgacatcattgctggcctggtgctgctccggcagcggcagcgggccaagcgcaacgccgtgctggacgaggcaaacaatgacatcttggccttcctgtctgggatgccggtgaccagaaacaccaagtacctcgacctcaagaattcacaagagatgctccgctacaaagaggtctgctactacatgctctttgccctggctgcctacgggtggcccatgtacctgatgcggaagcccgcctgcggcctctgccaactggctcggtcctgctcgtgttgcctgtgtcctgcgaggccgcggttcgcccctggagtcaccatcgaggaagacaactgctgtggctgtaatgccattgccatccggcgccacttcctggacgagaacatgactgcggtggacatcgtctatacctcctgccatgatgcggtctatgaaacgcccttctacgtggcggtggaccatgacaagaagaaagtggtgatcagtatccgggggaccctgtcccccaaggatgccctgactgacctgacgggtgatgctgagcgcctccccgtggaggggcaccacggcacctggctgggccacaagggtatggtcctctcagctgagtacatcaagaagaaactggagcaggagatggtcctgtcccaggcctttgggcgagacctgggccgcggaaccaaacactacggcctgattgtggtgggccactccctgggcgcgggcactgctgccatcctctccttccttctgcgcccacagtatccgaccctcaagtgctttgcctactccccgccagggggcctgctgagtgaggatgcgatggagtattccaaggagttcgtgactgctgtggttctgggcaaagacctcgtccccaggattggcctctctcagctggaaggcttccgcagacagctcctggatgtcctgcagcgaagcaccaagcccaaaatgaggggttggctgggcttccagccccttgccagccctgaaattcaacaattccatg

SEQ ID NO: 2125 - DNA, 182 bp, synthetic construct
  misc_feature 1..182: note = Synthetic polypeptide
  source 1..182: mol_type = other DNA
atgggcaacacggtgcaccggaccctgccagagagcgccttcgctgacacgctgacgcccgcgcgcctcagccaggcccgcttcagcgcctgcctgccgcccagcagccacgacgcggccaacttcgacaacaacgagctcgagaacaaccagaatgtgtgtgtgagagagagagagagaga

SEQ ID NO: 2126 - DNA, 728 bp, synthetic construct
  misc_feature 1..728: note = Synthetic polypeptide
  source 1..728: mol_type = other DNA
atgggcaacacggtgcaccggaccctgccagacccgagcccaccggcgcgcctcctggccacccggccgtgctgcggccccggccccgagcgacgcccggtcctgggcgaggcgccgcgcttccacgcgcaggccaaaggcaagaacgtgcggctggacggccactcgcgccgggccacacggcgcaacagcttctgcaatggcgtcacgttcacgcagcggcccatccggctgtacgagcaggtgcggctgcgcctggtggccgtgcgccctggctggagcggcgcgctgcgcttcggcttcaccgcgcacgatccgtcgctcatgagcgcccaggacatccccaagtacgcctgcccggacctggtcacgcggccgggctactgggccaaggcactgcccgagaacctggcgctgcgcgacacggtgctggcctactgggccgaccgccacggccgcgtgttctacagcgtgaacgacggcgagccggtgctcttccactgcggcgtggccgtgggcggcccgctctgggcgctcattgatgtctacggcatcaccgacgaggtgcagcttctggagagcgccttcgctgacacgctgacgcccgcgcgcctcagccaggcccgcttcagcgcctgcctgccgcccagcagccacgacgcggccaacttcgacaacaacgagctcgagaacaaccagaatgtgtgtgtgagagagagagagagaga

SEQ ID NO: 2127 - DNA, 2849 bp, synthetic construct; identical to SEQ ID NO: 1326
  misc_feature 1..2849: note = Synthetic polypeptide
  source 1..2849: mol_type = other DNA

SEQ ID NO: 2128 - DNA, 1925 bp, synthetic construct; identical to SEQ ID NO: 1327
  misc_feature 1..1925: note = Synthetic polypeptide
  source 1..1925: mol_type = other DNA

SEQ ID NO: 2129 - DNA, 2729 bp, synthetic construct; identical to SEQ ID NO: 1328
  misc_feature 1..2729: note = Synthetic polypeptide
  source 1..2729: mol_type = other DNA

SEQ ID NO: 2130 - DNA, 2549 bp, synthetic construct; identical to SEQ ID NO: 1329
  misc_feature 1..2549: note = Synthetic polypeptide
  source 1..2549: mol_type = other DNA

SEQ ID NO: 2131 - DNA, 1093 bp, synthetic construct
  misc_feature 1..1093: note = Synthetic polypeptide
  source 1..1093: mol_type = other DNA
atgcatgaaaggttcatccattgcttctgtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaaggtgcagtgacgcatgcctttagttgcagctacttgagaagctgaggcaggaggatcacttgagcccaggagttggaggctgcagtgagctgtggtcacaccactgcactccagcctggggcaacagagcaagaccctatctttaaaaaaaaaaaaaaaga

SEQ ID NO: 2132 - DNA, 1234 bp, synthetic construct
  misc_feature 1..1234: note = Synthetic polypeptide
  source 1..1234: mol_type = other DNA
atgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaaggtgcagtgacgcatgcctttagttgcagctacttgagaagctgaggcaggaggatcacttgagcccaggagttggaggctgcagtgagctgtggtcacaccactgcactccagcctggggcaacagagcaagaccctatctttaaaaaaaaaaaaaaaga

SEQ ID NO: 2133 - DNA, 258 bp, synthetic construct; identical to SEQ ID NO: 265
  misc_feature 1..258: note = Synthetic polypeptide
  source 1..258: mol_type = other DNA

SEQ ID NO: 2134 - DNA, 243 bp, synthetic construct; identical to SEQ ID NO: 267
  misc_feature 1..243: note = Synthetic polypeptide
  source 1..243: mol_type = other DNA

SEQ ID NO: 2135 - DNA, 324 bp, synthetic construct; identical to SEQ ID NO: 268
  misc_feature 1..324: note = Synthetic polypeptide
  source 1..324: mol_type = other DNA

SEQ ID NO: 2136 - DNA, 1791 bp, synthetic construct
  misc_feature 1..1791: note = Synthetic polypeptide
  source 1..1791: mol_type = other DNA
atgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttggacataaagtacatcgaggtgacctccgccagatcaaggtgccacgatggcccccagcactgctccagcccctctgtcaccccgcccttcggctcccttcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggcacagtggctcacgccagtaatcccagcactttgggaggccgaggcaggaggatcacttgagcccaggaatctgagaccagcttgagcaatatggcaaaaccctgtcgctacaaaaattacccaggtgtggtggagcacacctgtagtcccaggtacttgggagcctgaggcagcagaatcacttgaacccaggaggtctttgaggctgcagtgagccatgatcacaccactgcactccttcctagaccaaagaatgagaccctgtctaaaaaaaataaaataaaataa

SEQ ID NO: 2137 - DNA, 466 bp, synthetic construct
  misc_feature 1..466: note = Synthetic polypeptide
  source 1..466: mol_type = other DNA
atgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagttttactggcata

SEQ ID NO: 2138 - DNA, 644 bp, synthetic construct
  misc_feature 1..644: note = Synthetic polypeptide
  source 1..644: mol_type = other DNA
atgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaaggaggtaggaggacaggagccatggtgcctagaacaaagcagctcctcagtaaacatttgttgaatgaa

SEQ ID NO: 2139 - DNA, 255 bp, synthetic construct
  misc_feature 1..255: note = Synthetic polypeptide
  source 1..255: mol_type = other DNA
ggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaaggaggtaggaggacaggagccatggtgcctagaacaaagcagctcctcagtaaacatttgttgaatgaa

SEQ ID NO: 2140 - DNA, 2365 bp, synthetic construct
  misc_feature 1..2365: note = Synthetic polypeptide
  source 1..2365: mol_type = other DNA
atggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtatgctctgctggatccagagggaggactgcttccaccagaagacacagttgaactaaattccattgaactagaagttaagactgccatccaaccactttgggctccttatgcctctgagtcaacaggccaataggggagttatggtgttggctggggtaattgatccagactaccatggggaaatctgacataaaagaggtaaaaaagaatatgtctggaacacaggagatctcttagggtgtctcagtattaccatgccctgtggttaaagtcaatggaaaactacaacccaaaccaggcaagactatgaatggcccagacctttaggaatgaaggtttggtttacctcccctccaccctcaaaccaaccttggccttctaggttaagaagcataaccagctgaggttcttgctgaaggcaaagggaatacaggatgggtagttgaagatggtagttgtaagtatgagctgcagccatgtcatcagttacagaaaagaagactgtaattgtcatgaatatttcatccctattttttttaaataatgtgtgtatgtacacatatattaaacaaatatctttgtttcctttcctttcttatcccttatcgtgtaacataagatgtattgactttatactagtattctaagtactagtattgttaatactttaaagacatcttagtattttaagtatgggatatcagaagactacacgtcactcacagactttacctcctcttctggaaaagggattactgcattttttgttgtatgcaggatagttgtatcatgttaagtggaattatgaccttgttattgtcattatttggagattaactatggtttaaggagatacatatggatgccaagttcacaaggggcagact

SEQ ID NO: 2141 - DNA, 257 bp, synthetic construct
  misc_feature 1..257: note = Synthetic polypeptide
  source 1..257: mol_type = other DNA
gcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggaggttgcagtgagctgagatcgcgccattgtactccagcctgggcaacaagagcgaaactctgtctcaacaacaacaaaaa

SEQ ID NO: 2142 - DNA, 1778 bp, synthetic construct
  misc_feature 1..1778: note = Synthetic polypeptide
  source 1..1778: mol_type = other DNA
atgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggaggttgcagtgagctgagatcgcgccattgtactccagcctgggcaacaagagcgaaactctgtctcaacaacaacaaaaa

SEQ ID NO: 2143 - DNA, 2021 bp, synthetic construct
  misc_feature 1..2021: note = Synthetic polypeptide
  source 1..2021: mol_type = other DNA
atgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggaggttgcagtgagctgagatcgcgccattgtactccagcctgggcaacaagagcgaaactctgtctcaacaacaacaaaaa

SEQ ID NO: 2144 - DNA, 1175 bp, synthetic construct
  misc_feature 1..1175: note = Synthetic polypeptide
  source 1..1175: mol_type = other DNA
atggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggaggttgcagtgagctgagatcgcgccattgtactccagcctgggcaacaagagcgaaactctgtctcaacaacaacaaaaa

SEQ ID NO: 2145 - DNA, 1839 bp, synthetic construct; identical to SEQ ID NO: 1059
  misc_feature 1..1839: note = Synthetic polypeptide
  source 1..1839: mol_type = other DNA

SEQ ID NO: 2146 - DNA, 1400 bp, synthetic construct
  misc_feature 1..1400: note = Synthetic polypeptide
  source 1..1400: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggcaggagaatcgcttgaacccgggaggtggagattgcagtgagcccagatcgcaccactgcactccagtctggcaacagagcaagactccatctcaaaaagaaaagaaaagaa

SEQ ID NO: 2147 - DNA, 1403 bp, synthetic construct
  misc_feature 1..1403: note = Synthetic polypeptide
  source 1..1403: mol_type = other DNA
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggcaggagaatcgcttgaacccgggaggtggagattgcagtgagcccagatcgcaccactgcactccagtctggcaacagagcaagactccatctcaaaaagaaaagaaaagaa

SEQ ID NO: 2148 - DNA, 755 bp, synthetic construct
  misc_feature 1..755: note = Synthetic polypeptide
  source 1..755: mol_type = other DNA
atgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggc

SEQ ID NO: 2149 - DNA, 290 bp, synthetic construct
  misc_feature 1..290: note = Synthetic polypeptide
  source 1..290: mol_type = other DNA
atgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggc

SEQ ID NO: 2150 - DNA, 800 bp, synthetic construct
  misc_feature 1..800: note = Synthetic polypeptide
  source 1..800: mol_type = other DNA
atgattcttcaagaaaccaaagcagcctgtggcattccagcgattcctcattgctcaagggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggc

SEQ ID NO: 2151 - DNA, 281 bp, synthetic construct
  misc_feature 1..281: note = Synthetic polypeptide
  source 1..281: mol_type = other DNA
agacgctcttcgtgcaccgcttctcccatggcactatgcctttgcgcaacatcttcaagaactgcacctactactggggcttcgccgcgtggatggcctattacatcaatcaccctctctacactccccctaatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggc

SEQ ID NO: 2152 - DNA, 1838 bp, synthetic construct
  misc_feature 1..1838: note = Synthetic polypeptide
  source 1..1838: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggggg

SEQ ID NO: 2153 - DNA, 586 bp, synthetic construct; identical to SEQ ID NO: 401
  misc_feature 1..586: note = Synthetic polypeptide
  source 1..586: mol_type = other DNA

SEQ ID NO: 2154 - DNA, 829 bp, synthetic construct; identical to SEQ ID NO: 402
  misc_feature 1..829: note = Synthetic polypeptide
  source 1..829: mol_type = other DNA

SEQ ID NO: 2155 - DNA, 1060 bp, synthetic construct; identical to SEQ ID NO: 403
  misc_feature 1..1060: note = Synthetic polypeptide
  source 1..1060: mol_type = other DNA

SEQ ID NO: 2156 - DNA, 730 bp, synthetic construct; identical to SEQ ID NO: 406
  misc_feature 1..730: note = Synthetic polypeptide
  source 1..730: mol_type = other DNA

SEQ ID NO: 2157 - DNA, 496 bp, synthetic construct; identical to SEQ ID NO: 408
  misc_feature 1..496: note = Synthetic polypeptide
  source 1..496: mol_type = other DNA

SEQ ID NO: 2158 - DNA, 121 bp, synthetic construct
  misc_feature 1..121: note = Synthetic polypeptide
  source 1..121: mol_type = other DNA
atgaagaagtcttactcaggaggcacgcggacctccagtggccggctccggaggcttggtgactccagtggcccagccccacagctgtggtccattatggcagccacaggacactgatgca

SEQ ID NO: 2159 - DNA, 1142 bp, synthetic construct
  misc_feature 1..1142: note = Synthetic polypeptide
  source 1..1142: mol_type = other DNA
atgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaa

SEQ ID NO: 2160 - DNA, 1041 bp, synthetic construct
  misc_feature 1..1041: note = Synthetic polypeptide
  source 1..1041: mol_type = other DNA
atggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagcttgcagtgagccgagatatcgccactgcactccagcctgggtgacagagcgagactccatctcaaaaaaaaaaaaaaaaagaa

SEQ ID NO: 2161 - DNA, 987 bp, synthetic construct
  misc_feature 1..987: note = Synthetic polypeptide
  source 1..987: mol_type = other DNA
atggagggagctgctttgctgagagtctctgtcctctgcatctgggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagcttgcagtgagccgagatatcgccactgcactccagcctgggtgacagagcgagactccatctcaaaaaaaaaaaaaaaaagaa

SEQ ID NO: 2162 - DNA, 1089 bp, synthetic construct
  misc_feature 1..1089: note = Synthetic polypeptide
  source 1..1089: mol_type = other DNA
atgagattcaaaagccacactgtggaattgaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagcttgcagtgagccgagatatcgccactgcactccagcctgggtgacagagcgagactccatctcaaaaaaaaaaaaaaaaagaa

SEQ ID NO: 2163 - DNA, 678 bp, synthetic construct
  misc_feature 1..678: note = Synthetic polypeptide
  source 1..678: mol_type = other DNA
atgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagcttgcagtgagccgagatatcgccactgcactccagcctgggtgacagagcgagactccatctcaaaaaaaaaaaaaaaaagaa

SEQ ID NO: 2164 - DNA, 1277 bp, synthetic construct
  misc_feature 1..1277: note = Synthetic polypeptide
  source 1..1277: mol_type = other DNA
atggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 2165 - DNA, 1223 bp, synthetic construct
  misc_feature 1..1223: note = Synthetic polypeptide
  source 1..1223: mol_type = other DNA
atggagggagctgctttgctgagagtctctgtcctctgcatctgggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 2166 - DNA, 1325 bp, synthetic construct
  misc_feature 1..1325: note = Synthetic polypeptide
  source 1..1325: mol_type = other DNA
atgagattcaaaagccacactgtggaattgaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 2167 - DNA, 914 bp, synthetic construct
  misc_feature 1..914: note = Synthetic polypeptide
  source 1..914: mol_type = other DNA
atgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 2168 - DNA, 199 bp, synthetic construct
  misc_feature 1..199: note = Synthetic polypeptide
  source 1..199: mol_type = other DNA
atggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccatctgaaaaacctcttgcacatggacaaacatttattggaggaatgaa

SEQ ID NO: 2169 - DNA, 578 bp, synthetic construct
  misc_feature 1..578: note = Synthetic polypeptide
  source 1..578: mol_type = other DNA
atggcctggtggaaatcctggattgaacaggagggtgtcacagtgaagagcagctcccacttcaacccagaccctgatgcagagaccctctaccaagccatgaaggggatcggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcagcagggatgatgtgagcagctttgtggacccaggactggccctccaagacgcacaggttatacagaccccagccccattcccatctactgaaacagggtctccacaagaggggccagggaatatgggtttttaacaagc

SEQ ID NO: 2170 - DNA, 635 bp, synthetic construct
  misc_feature 1..635: note = Synthetic polypeptide
  source 1..635: mol_type = other DNA
atggcctggtggaaatcctggattgaacaggagggtgtcacagtgaagagcagctcccacttcaacccagaccctgatgcagagaccctctaccaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggttatacagaccccagccccattcccatctactgaaacagggtctccacaagaggggccagggaatatgggtttttaacaagc

SEQ ID NO: 2171 - DNA, 449 bp, synthetic construct; identical to SEQ ID NO: 2123
  misc_feature 1..449: note = Synthetic polypeptide
  source 1..449: mol_type = other DNA

SEQ ID NO: 2172 - DNA, 186 bp, synthetic construct
  misc_feature 1..186: note = Synthetic polypeptide
  source 1..186: mol_type = other DNA
atggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaagatgcgatataaaggtgtaattattatt

SEQ ID NO: 2173 - DNA, 1273 bp, synthetic construct
  misc_feature 1..1273: note = Synthetic polypeptide
  source 1..1273: mol_type = other DNA
atgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggcagatcacctgagcaggagttcgagaccagcctggccaacatggtgaaaccccgtgaacactaaaaatacaaaaaattagccaggcgtggtggtgcatgcctgtaatcccagctactcaggaggctgaggcaggagaatcacttgaacccgggagggagaggttgcagtgaaccgagatcatgccactgcaccccagcctgggcaagaagaaggaaactcctcctcaaaaaaaaaaaaaaaaa

SEQ ID NO: 2174 - DNA, 1091 bp, synthetic construct
  misc_feature 1..1091: note = Synthetic polypeptide
  source 1..1091: mol_type = other DNA
atgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgataaagtgtgttgttatgaggattcaatgaggagacctgtatgaagtgccttcccctgtgcctggctcatagtaagtgttcagtgagttttggt

SEQ ID NO: 2175 - DNA, 677 bp, synthetic construct
  misc_feature 1..677: note = Synthetic polypeptide
  source 1..677: mol_type = other DNA
atggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggccaggtgtggtggttcacgcctgtaatcccagcacttttggaggctgaggagggcggatcacctgaggtcgtgagttcaagaccagcctggccaacatggtgaaaccccatctctactgaaaacacaaaaattagctgggtgtggtggtgcacgcctgtaatcccatatactccagaggctgaggcatgagaatcacctcaactcgggagccgagatcgcaccactgcactccagcctaagcaacagaagactgtctaaaaaaaaaagaaaaaagaaaagaaaagaaa

SEQ ID NO: 2176 - DNA, 563 bp, synthetic construct
  misc_feature 1..563: note = Synthetic polypeptide
  source 1..563: mol_type = other DNA
atggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcggagacgtcttgagtgaagatgaaaatgacaagaagcaaaatgcccagtcttcggacgagtcctttgagccttacccagaaaggaaccctatacccagcagtacccagaacactcccaggta

SEQ ID NO: 2177 - DNA, 980 bp, synthetic construct
  misc_feature 1..980: note = Synthetic polypeptide
  source 1..980: mol_type = other DNA
atgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcgggtaaaagacgagttcagtgacctttctgagggagacgtcttgagtgaagatgaaaatgacaagaagcaaaatgcccagtcttcggacgagtcctttgagccttacccagaaaggaaccctatacccagcagtacccagaacactcccaggta

SEQ ID NO: 2178 - DNA, 929 bp, synthetic construct
  misc_feature 1..929: note = Synthetic polypeptide
  source 1..929: mol_type = other DNA
atgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcggagacgtcttgagtgaagatgaaaatgacaagaagcaaaatgcccagtcttcggacgagtcctttgagccttacccagaaaggaaccctatacccagcagtacccagaacactcccaggta

SEQ ID NO: 2179 - DNA, 1205 bp, synthetic construct
  misc_feature 1..1205: note = Synthetic polypeptide
  source 1..1205: mol_type = other DNA
atgaagcgggaccggctgggccgcttcctgtctcctgggtcgtcccgacagtgcggggcctcggacggcggcggcggcgtcagccggactcggggccgcccttcccttagcggtgggccgagggtggacggggcgacggcgcggcgcgcctggggcccggtggggtcctgcggggacgcgggcgaggacggcgcggacgaggcaggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcgggtaaaagacgagttcagtgacctttctgagggagacgtcttgagtgaagatgaaaatgacaagaagcaaaatgcccagtcttcggacgagtcctttgagccttacccagaaaggaaccctatacccagcagtacccagaacactcccaggta

SEQ ID NO: 2180 - DNA, 2572 bp, synthetic construct; identical to SEQ ID NO: 1541
  misc_feature 1..2572: note = Synthetic polypeptide
  source 1..2572: mol_type = other DNA

SEQ ID NO: 2181 - DNA, 2407 bp, synthetic construct; identical to SEQ ID NO: 1542
  misc_feature 1..2407: note = Synthetic polypeptide
  source 1..2407: mol_type = other DNA

SEQ ID NO: 2182 - DNA, 651 bp, synthetic construct; identical to SEQ ID NO: 1543
  misc_feature 1..651: note = Synthetic polypeptide
  source 1..651: mol_type = other DNA

SEQ ID NO: 2183 - DNA, 391 bp, synthetic construct; identical to SEQ ID NO: 1544
  misc_feature 1..391: note = Synthetic polypeptide
  source 1..391: mol_type = other DNA

SEQ ID NO: 2184 - DNA, 847 bp, synthetic construct; identical to SEQ ID NO: 1423
  misc_feature 1..847: note = Synthetic polypeptide
  source 1..847: mol_type = other DNA

SEQ ID NO: 2185 - DNA, 793 bp, synthetic construct; identical to SEQ ID NO: 1424
  misc_feature 1..793: note = Synthetic polypeptide
  source 1..793: mol_type = other DNA

SEQ ID NO: 2186 - DNA, 418 bp, synthetic construct; identical to SEQ ID NO: 1425
  misc_feature 1..418: note = Synthetic polypeptide
  source 1..418: mol_type = other DNA

SEQ ID NO: 2187 - DNA, 798 bp, synthetic construct; identical to SEQ ID NO: 1426
  misc_feature 1..798: note = Synthetic polypeptide
  source 1..798: mol_type = other DNA

SEQ ID NO: 2188 - DNA, 1638 bp, synthetic construct
  misc_feature 1..1638: note = Synthetic polypeptide
  source 1..1638: mol_type = other DNA
atgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtattagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggcacggtggctcatgcctgtaatcacagcactttggaagtccgaggtgggtggatcacctgaggtcaagagttcgagaccagcctggccaacatggcgaaaccctgtctctgctaaaaatgcaagaattagccatgtgtggtggtgggcgcctataatcccagctactcagaaggctgaggcaggagaatcgcttgaacccgggaagcggaagttgcagtgagccaagtttgtgttattgcactccagcttgggcaagagtgaaactgtcttaaaaaaaaaaaaaaaaaaa

SEQ ID NO: 2189 - DNA, 578 bp, synthetic construct
  misc_feature 1..578: note = Synthetic polypeptide
  source 1..578: mol_type = other DNA
atggcctggtggaaagcctggattgaacaggagggtgtcacagtgaagagcagctcccacttcaacccagaccctgatgcagagaccctctacaaagccatgaaggggatcggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcagcagggatgatgtgagcagctttgtggacccggcactggccctccaagacgcacaggttatacagaccccagccccattcccatctactgaaacagggtctccacaagaggggccagggaatatgggtttttaacaagc

SEQ ID NO: 2190 - DNA, 635 bp, synthetic construct
  misc_feature 1..635: note = Synthetic polypeptide
  source 1..635: mol_type = other DNA
atggcctggtggaaagcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggttatacagaccccagccccattcccatctactgaaacagggtctccacaagaggggccagggaatatgggtttttaacaagc

SEQ ID NO: 2191 - DNA, 449 bp, synthetic construct
  misc_feature 1..449: note = Synthetic polypeptide
  source 1..449: mol_type = other DNA
atggcctggtggaaagcctgggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggttatacagaccccagccccattcccatctactgaaacagggtctccacaagaggggccagggaatatgggtttttaacaagc

SEQ ID NO: 2192 - DNA, 980 bp, synthetic construct; identical to SEQ ID NO: 139
  misc_feature 1..980: note = Synthetic polypeptide
  source 1..980: mol_type = other DNA

SEQ ID NO: 2193 - DNA, 1256 bp, synthetic construct; identical to SEQ ID NO: 140
  misc_feature 1..1256: note = Synthetic polypeptide
  source 1..1256: mol_type = other DNA

SEQ ID NO: 2194 - DNA, 1277 bp, synthetic construct; identical to SEQ ID NO: 142
  misc_feature 1..1277: note = Synthetic polypeptide
  source 1..1277: mol_type = other DNA

SEQ ID NO: 2195 - DNA, 665 bp, synthetic construct
  misc_feature 1..665: note = Synthetic polypeptide
  source 1..665: mol_type = other DNA
atgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggctgtgccagctctcctgtccaggcatgagtgcccagagacctaga

SEQ ID NO: 2196 - DNA, 2344 bp, synthetic construct
  misc_feature 1..2344: note = Synthetic polypeptide
  source 1..2344: mol_type = other DNA
atgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggaaaaaaaaagatactcatgtttggctactgcttggtgaaacattatgccttggaaaccttcctactcttttgtggcttggaagaagaaaattggaaaagtgcttatgtcaaatgatatcatctgctgtataaccactaacatgtcttctaatattttgaag

SEQ ID NO: 2197 - DNA, 2017 bp, synthetic construct
  misc_feature 1..2017: note = Synthetic polypeptide
  source 1..2017: mol_type = other DNA
atgtcaagttcaggttatcctcccaaccaaggagcattcagcacagaacaaagtcgttatcctcctcactctgtccagtatacatttcccaacacccgccaccagcaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggaaaaaaaaagatactcatgtttggctactgcttggtgaaacattatgccttggaaaccttcctactcttttgtggcttggaagaagaaaattggaaaagtgcttatgtcaaatgatatcatctgctgtataaccactaacatgtcttctaatattttgaag

SEQ ID NO: 2198 - DNA, 763 bp, synthetic construct; identical to SEQ ID NO: 261
  misc_feature 1..763: note = Synthetic polypeptide
  source 1..763: mol_type = other DNA

SEQ ID NO: 2199 - DNA, 646 bp, synthetic construct; identical to SEQ ID NO: 262
  misc_feature 1..646: note = Synthetic polypeptide
  source 1..646: mol_type = other DNA

SEQ ID NO: 2200 - DNA, 1372 bp, synthetic construct; identical to SEQ ID NO: 1756
  misc_feature 1..1372: note = Synthetic polypeptide
  source 1..1372: mol_type = other DNA

SEQ ID NO: 2201 - DNA, 1166 bp, synthetic construct
  misc_feature 1..1166: note = Synthetic polypeptide
  source 1..1166: mol_type = other DNA
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccagagacagggagagacagagagagatagagagacagagatagagacagagatacagagacacagagaaagacagagagagatagagacagagagatacagagagacagagaaagagatagagagacagagatagagacagaaagacagagatagagatagagatgaaagacagagatacagagagacagagaaagacagagagatagacatgagagagacagagatagagatacagagagacagaaagagagatagagacagagcgatagagataagagaaaga

SEQ ID NO: 2202 - DNA, 1061 bp, synthetic construct
  misc_feature 1..1061: note = Synthetic polypeptide
  source 1..1061: mol_type = other DNA
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccagagacagggagagacagagagagatagagagacagagatagagacagagatacagagacacagagaaagacagagagagatagagacagagagatacagagagacagagaaagagatagagagacagagatagagacagaaagacagagatagagatagagatgaaagacagagatacagagagacagagaaagacagagagatagacatgagagagacagagatagagatacagagagacagaaagagagatagagacagagcgatagagataagagaaaga

SEQ ID NO: 2203 - DNA, 24 bp, synthetic construct
  misc_feature 1..24: note = Synthetic polypeptide
  source 1..24: mol_type = other DNA
atggaagccttccctgactgccta

SEQ ID NO: 2204 - DNA, 965 bp, synthetic construct; identical to SEQ ID NO: 1615
  misc_feature 1..965: note = Synthetic polypeptide
  source 1..965: mol_type = other DNA

SEQ ID NO: 2205 - DNA, 843 bp, synthetic construct
  misc_feature 1..843: note = Synthetic polypeptide
  source 1..843: mol_type = other DNA
atgtcgaaccccgggacacgcaggaacggctccagcatcaagatccgtctgacagaatttgacaagctgattaaaatttatctggaaatgcaagagatctagaatagctcaaacagtcctgaaaaaacaacaacaaagttggagactagcacttctcaatttcaaaacttactacaaagctaaagtaattacgacagaatggtactgacagtagcgtagatatagaggtcaatagaatagacttcggaatccagaaataagtcctcatatttatggtcagttgattttcaacagtgatgacaagataatttgacaggggaaataatagtcttttcaacaaatggtcctggaacaagtggatatacacatgtaaaagaatgaaattgagctcctacctcaagaactcctaggagaaaacaggaataaatcttcaatactttggtctagacatggaatcttagatatgacaaacaaagcacaggcaacaaaaggaaaacagattaattggatttcatcaaaattcaaagcttctgtgcttcaaaggactcttgaagaaaaagaaaactcacagcatgggagaaaatgtttgcaaattatgtttgaaaagggtcttgtctctaaaatatataaagaacccttacaactccacaatgaaaaacaaataactcagtttaatacatgggtaaaggatctgaacagacatttctccaaagaaggctaccaacatggccaataagcccatgaaaagatgctcagcatcaaagtctcagagacatgccaatcaaaaccgtggtgagataccccgtagactcactagatggctaaaattaaaaaatgcgatca

SEQ ID NO: 2206 - DNA, 446 bp, synthetic construct
  misc_feature 1..446: note = Synthetic polypeptide
  source 1..446: mol_type = other DNA
atgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagctccagaacagctccagagtgataaaggtgaaagacagtcttttgtt

SEQ ID NO: 2207 - DNA, 206 bp, synthetic construct
  misc_feature 1..206: note = Synthetic polypeptide
  source 1..206: mol_type = other DNA
atggtgcttcagccaagtgaaaggcactatcgagattggaaccacagaagatgtgccttgcttccccttcgccttctgccatgattgtaagtttcctgagacctccccagccatgcagaactgtgagtcaattaaacttttctttataatttacccagtctcaggcagttatttatacaatagctgtgtgagaacgaactaatgca

SEQ ID NO: 2208 - DNA, 244 bp, synthetic construct
  misc_feature 1..244: note = Synthetic polypeptide
  source 1..244: mol_type = other DNA
atgatacctggaattgggacactcacccaggacacactatggtgcttcagccaagtgaaaggcactatcgagattggaaccacagaagatgtgccttgcttccccttcgccttctgccatgattgtaagtttcctgagacctccccagccatgcagaactgtgagtcaattaaacttttctttataatttacccagtctcaggcagttatttatacaatagctgtgtgagaacgaactaatgca

SEQ ID NO: 2209 - DNA, 229 bp, synthetic construct
  misc_feature 1..229: note = Synthetic polypeptide
  source 1..229: mol_type = other DNA
atggcggcgcctttgaggattcagagcgactgggcgcaagccctcaggaaggatgaaggggaggcctggctgagctgtcatcccccagcctgaggctctcatcagaagcagatgctggtgccatgcttcttgtacagtctgcagaaccgtgagccaaataaacctcttttctttataaattacccagcctcaggtattcctttatagcaacactaaacagactaagaca

SEQ ID NO: 2210 - DNA, 499 bp, synthetic construct
  misc_feature 1..499: note = Synthetic polypeptide
  source 1..499: mol_type = other DNA
atggagcagcctgaggacatggcgtcgctgagcgagttcgactccttggcgggcagcatcccggccaccaaggtggagatcaccgtgtcctgcaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacgataggcgcattcagcctgaattccaggacgggcaaacccatgccagctgtgtccaacggaagtggtctttggatggaaagtttgagaaccactg

SEQ ID NO: 2211 - DNA, 1563 bp, synthetic construct; identical to SEQ ID NO: 2008
  misc_feature 1..1563: note = Synthetic polypeptide
  source 1..1563: mol_type = other DNA

SEQ ID NO: 2212 - DNA, 802 bp, synthetic construct
  misc_feature 1..802: note = Synthetic polypeptide
  source 1..802: mol_type = other DNA
ggatggttgagtcctgcttgggctcaccttgctgggccagcccccaactccttcggatcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcct

SEQ ID NO: 2213 - DNA, 2141 bp, synthetic construct
  misc_feature 1..2141: note = Synthetic polypeptide
  source 1..2141: mol_type = other DNA
atgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcct

SEQ ID NO: 2214 - DNA, 2192 bp, synthetic construct
  misc_feature 1..2192: note = Synthetic polypeptide
  source 1..2192: mol_type = other DNA
atgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagatggtcagactgaggtccagagaggggaaggtactgacccaaagtcacacaaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcct

SEQ ID NO: 2215 - DNA, 2015 bp, synthetic construct
  misc_feature 1..2015: note = Synthetic polypeptide
  source 1..2015: mol_type = other DNA
atgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcct

SEQ ID NO: 2216 - DNA, 3391 bp, synthetic construct
  misc_feature 1..3391: note = Synthetic polypeptide
  source 1..3391: mol_type = other DNA
atgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaaccccccctctttcccggagccagacctgacggtggaaatctctgagagcgccacgccaggcactcgcttccccttggagagcgcattcgacccagacgtgggcaccaactccttgcgcgactacgagatcacccccaacagctacttctccctggacgtgcagacccagggggatggcaaccgattcgctgagctggtgctggagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccggggcgagcctgcgctctccaccagtaagtcgatccaggtacaagtgtcggatgtgaacgacaacgcgccgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacatcctcatagtggatcaaaatgacaacgcccctgccatcgtggcgcctctaccagggcgcaacgggactccagcgcgtgaggtgctgccccgctcggcggagccgggttacctgctcacccgcgtggccgccgtggacgcggacgacggcgagaacgcccggctcacttacagcatcgtgcgtggcaacgaaatgaacctctttcgcatggactggcgcaccggggagctgcgcacagcacgccgagtcccggccaagcgcgacccccagcggccttatgagctggtgatcgaggtgcgcgaccatgggcagccgcccctttcctccaccgccaccctggtggttcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactcagcaagtcagacatcatgctggtgcagagctccaatgtacccagtaacccggcccaggtgccgatagaggagtccgggggctttggctcccaccaccacaaccagaattactgctatcaggtatgcctgacccctgagtccgccaagaccgacctgatgtttcttaagccctgcagcccttcgcggagtacggacactgagcacaacccctgcggggccatcgtcaccggttacaccgaccagcagcctgatatcatctccaacggaagcattttgtccaacgagactaaacaccagcgagcagagctcagctatctagttgacagacctcgccgagttaacagttctgcattccaggaagccgacatagtaagctctaaggacagtggtcatggagacagtgaacagggagatagtgatcatgatgccaccaaccgtgcccagtcagctggtatggatctcttctccaattgcactgaggaatgtaaagctctgggccactcagatcggtgctggatgccttcttttgtcccttctgatggacgccaggctgctgattatcgcagcaatctgcatgttcctggcatggactctgttccagacactgaggtgtttgaaactccagaagcccagcctggggcagagcggtccttttccacctttggcaaagagaaggcccttcacagcactctggagaggaaggagctggatggactgctgactaatacgcgagcgccttacaaaccaccatatttgaagctattgtggaggcagctatgtggagagacacatgtggcacaagatcaagggctgtcaacaaccacatgagtgagcttggaaacagactcccaagttgagcattcagatgagaccacagcccctgctgacagtttgactgcaacctttgagagtccttagccagaggcacccagttaagctgcactaaaatttttgaaccacacagattgtgagataataaatatttgtggttttatgttgtgaggttttggggtatattgccatgtggcaataaatagttaataca

SEQ ID NO: 2217 - DNA, 1825 bp, synthetic construct; identical to SEQ ID NO: 1660
  misc_feature 1..1825: note = Synthetic polypeptide
  source 1..1825: mol_type = other DNA

SEQ ID NO: 2218 - DNA, 1825 bp, synthetic construct; identical to SEQ ID NO: 1661
  misc_feature 1..1825: note = Synthetic polypeptide
  source 1..1825: mol_type = other DNA

SEQ ID NO: 2219 - DNA, 410 bp, synthetic construct
  misc_feature 1..410: note = Synthetic polypeptide
  source 1..410: mol_type = other DNA
atgcagcccacagccaccatggccacagccgccaccaccaccaccaccaccactgccacagtagccctgacgacgtcgtgggacaatgccactggacgccccacggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaagactgggcgcagctcgattccgactcatctctgtttccttaacgcccaggcgtaggtgggcccaggcgcgtgctgagcgagtgagtgtgtgagcggatgga

SEQ ID NO: 2220 - DNA, 392 bp, synthetic construct
  misc_feature 1..392: note = Synthetic polypeptide
  source 1..392: mol_type = other DNA
atggccacagccgccaccaccaccaccaccaccactgccacagtagccctgacgacgtcgtgggacaatgccactggacgccccacggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaagactgggcgcagctcgattccgactcatctctgtttccttaacgcccaggcgtaggtgggcccaggcgcgtgctgagcgagtgagtgtgtgagcggatgga

SEQ ID NO: 2221 - DNA, 1063 bp, synthetic construct
  misc_feature 1..1063: note = Synthetic polypeptide
  source 1..1063: mol_type = other DNA
atgggccgggcccggcgcttccagtggccgctgctgctgctgtgggcggccgcggcggggccaggggcaggacaggaagtacagacagagaacgtgacagtggctgagggtggggtggctgagatcacctgccgtctgcaccagtatgatgggtccatagttgtcatccagaacccagcccggcagaccctcttcttcaatggcacccgtgccttgaaggatgagcgtttccagcttgaggagttctccccacgccgggtgcggatccggctctcagatgcccgcctggaggacgaggggggctatttctgccagctctacacagaagacacccaccaccagattgccacgctcacggtactagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggagtgagcagcagccaggaaaatggcaaggtctggagcgtggcaagcacagtacggtttcgtgtggaccgtaaggacgacggtggtatcatcatctgtgaggcgcagaaccaggcgctgccctccggacacagcaagcagacgcagtacgtgctggatgtgcagtactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacggtaaccgaacctgtctgcgcctcagtttacccatcagtaaagtggaaataaacaatagcacctatataacaaggctgttgtgaagattatgtgaactaaatatgtaaggtggttggaatgggctctagcacacag

SEQ ID NO: 2222 - DNA, 628 bp, synthetic construct
  misc_feature 1..628: note = Synthetic polypeptide
  source 1..628: mol_type = other DNA
atggccctgaccctgtttgatacagatgaatatagacctcctgtttggaaatcttacttatatcagctacaacaggaagcccctcatcctcgaagaattacctgtacttgcgaggcaaggatcatcagtcattggatgttaaaaccattggaagaaaggctgtaggtgaacaggatatttacatggtctcaaggtatgacaccaccaattatttgttaattgcatagagaaaaatatgcctttaaagtggagagatctggtggtcaaacttagcattacctgtaatgggacaaactgtcatgtgtctcctgaagtgatacagtgaaacacacggtatcacctgtataatatttttgccaaaactgtttaacttaaatctagttataaagtacgaatcagacaaattcagaatgtgtaccttccataagacatctgccctgggtttataaataatgtcattatcataaaaaaaaaacagtggtgggatgatataaaattaaaggagactaaagagacatggccatcagattcaaggaccttgatcgggtcctcaacttatatatatattgtaaagctataaattttgagtacaattggataaatttgagtatggactgtattaggtaat

SEQ ID NO: 2223 - DNA, 190 bp, synthetic construct; identical to SEQ ID NO: 1996
  misc_feature 1..190: note = Synthetic polypeptide
  source 1..190: mol_type = other DNA

SEQ ID NO: 2224 - DNA, 1728 bp, synthetic construct
  misc_feature 1..1728: note = Synthetic polypeptide
  source 1..1728: mol_type = other DNA
atgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagcactgttcacaggagcaaagtcttggaaccaacccaaatgcccatcaacgatagactggatacagaaatgtggtacgtatataccatggaatactatgcaaccatagaaaaggatgagttcctgtcctttgcagggacatggatgaaactggaaaccatcatcctcagcaaactaacacaggaacagaaaaccaaacactgtatgttctcactcataagtgggagttgaacaatgagaaaacatggacacagggagggggacatcacacactggggcctgtcgggaggtgggggctaggggagggatagcattaggagaaatacctaatgtagatgacgagttgatgagtgcagcaacccaccatggtacgtgtgtacctatgtaacaaacctgcatgttctgcacatgcatcccagaacttaaagtataacaacaaaaaaa

SEQ ID NO: 2225 - DNA, 1680 bp, synthetic construct
  misc_feature 1..1680: note = Synthetic polypeptide
  source 1..1680: mol_type = other DNA
atgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggatgagagagacctagagaaagatgatgaactggaactgaaaagaagtcttttatgtagagactctgcctatgacagtgaccccgagtatagcactgttcacaggagcaaagtcttggaaccaacccaaatgcccatcaacgatagactggatacagaaatgtggtacgtatataccatggaatactatgcaaccatagaaaaggatgagttcctgtcctttgcagggacatggatgaaactggaaaccatcatcctcagcaaactaacacaggaacagaaaaccaaacactgtatgttctcactcataagtgggagttgaacaatgagaaaacatggacacagggagggggacatcacacactggggcctgtcgggaggtgggggctaggggagggatagcattaggagaaatacctaatgtagatgacgagttgatgagtgcagcaacccaccatggtacgtgtgtacctatgtaacaaacctgcatgttctgcacatgcatcccagaacttaaagtataacaacaaaaaaa

SEQ ID NO: 2226 - DNA, 1512 bp, synthetic construct
  misc_feature 1..1512: note = Synthetic polypeptide
  source 1..1512: mol_type = other DNA
atggtgtttgaaaaggtgttcccggacgcagtagatcctggagatgtggttacacagcttgaattgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagcactgttcacaggagcaaagtcttggaaccaacccaaatgcccatcaacgatagactggatacagaaatgtggtacgtatataccatggaatactatgcaaccatagaaaaggatgagttcctgtcctttgcagggacatggatgaaactggaaaccatcatcctcagcaaactaacacaggaacagaaaaccaaacactgtatgttctcactcataagtgggagttgaacaatgagaaaacatggacacagggagggggacatcacacactggggcctgtcgggaggtgggggctaggggagggatagcattaggagaaatacctaatgtagatgacgagttgatgagtgcagcaacccaccatggtacgtgtgtacctatgtaacaaacctgcatgttctgcacatgcatcccagaacttaaagtataacaacaaaaaaa

SEQ ID NO: 2227 - DNA, 154 bp, synthetic construct
  misc_feature 1..154: note = Synthetic polypeptide
  source 1..154: mol_type = other DNA
atggcttccaattttaatgacatagtgaagcaagggtacgtgaggatccggagcagacgcctcggggtgctgatcctgagagccctccgcagtgaacaccctgcatgcagatctccttcttggaacctgttcctggaaaacccagtctccagca

SEQ ID NO: 2228 - DNA, 480 bp, synthetic construct
  misc_feature 1..480: note = Synthetic polypeptide
  source 1..480: mol_type = other DNA
atggcggtgtctacagtgttctcgacttcgtcgctggtgactgggtacctggatatgtgatcgagtattcttctgggtgtttctatgaggatgtttttggatgaaattggcatttaaattggtaaactgagtaaagcagtctgtccccctaaccggggtgggcttcatgtaatcagctcaaggtttgaatacaacaaaaagacttacactctcgcaagtgaaaggcaattctttctgcctggtagccttcaaactgagacacaggcttttatcctgccttcagattcgcctgggaacactggctcttcctgagtctcaagcctgctggccttgagacaagaactacatcagctctctcagttctcaagcctttggacttactctggaactaagccatcagctctcttgggtcgtcagcttgccaaccaactcatcctgaagatcttgggacttgccagccttcatagtcacgtgggccaa

SEQ ID NO: 2229 - DNA, 117 bp, synthetic construct; identical to SEQ ID NO: 928
  misc_feature 1..117: note = Synthetic polypeptide
  source 1..117: mol_type = other DNA

SEQ ID NO: 2230 - DNA, 51 bp, synthetic construct; identical to SEQ ID NO: 929
  misc_feature 1..51: note = Synthetic polypeptide
  source 1..51: mol_type = other DNA

SEQ ID NO: 2231 - DNA, 162 bp, synthetic construct
  misc_feature 1..162: note = Synthetic polypeptide
  source 1..162: mol_type = other DNA
atgttgcgcaagtttacacttctgaccccatcacactgcttcccactgagatgcaagagaggattcctcatcttccagatgtgcaggctgaaatatttatggatgaaattgtcagatgcctagcatttgctccatgataatctgaggtaaggaagacagtgg

SEQ ID NO: 2232 - DNA, 1030 bp, synthetic construct
  misc_feature 1..1030: note = Synthetic polypeptide
  source 1..1030: mol_type = other DNA
atggccattgcttacctgggatcctcatgcccctcacaaccacccagctccctagctctctccctctcccccaccccctcagacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagcttggaggagtagaaagagcatggtcttgaagtcaagcagac

SEQ ID NO: 2233 - DNA, 1204 bp, synthetic construct
  misc_feature 1..1204: note = Synthetic polypeptide
  source 1..1204: mol_type = other DNA
atgaagccggggccgccgcaccgtgccggggccgcccacggggccggcgccggggccggggccgcggccgggcccggggcccgcgggctgctcctgccaccgctgctgctgctgctgctggcggggcgcgccgcgggggcccagcgctggcgcagtgagaacttcgagagacccgtggacctggagggctctggggatgatgactcctttcccgatgatgaactggatgacctctactcggggtcgggctcgggctacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagcttggaggagtagaaagagcatggtcttgaagtcaagcagac

SEQ ID NO: 2234 - DNA, 238 bp, synthetic construct
  misc_feature 1..238: note = Synthetic polypeptide
  source 1..238: mol_type = other DNA
atggcggcgcctttgaggattcagagcgactgggcgcaagccctcaggaaggatgaaggggaggcctggctgagctgtcatcccccagtggaagcagcctgaggctctcatcagaagcagatgctggtgccatgcttcttgtacagtctgcagaaccgtgagccaaataaacctcttttctttataaattacccagcctcaggtattcctttatagcaacactaaacagactaagaca

SEQ ID NO: 2235 - DNA, 377 bp, synthetic construct
  misc_feature 1..377: note = Synthetic polypeptide
  source 1..377: mol_type = other DNA
atgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagggctgctggcagggtgatagcagatgatggcacgaaggtcctttaggacatggcc

SEQ ID NO: 2236 - DNA, 347 bp, synthetic construct
  misc_feature 1..347: note = Synthetic polypeptide
  source 1..347: mol_type = other DNA
atggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagggctgctggcagggtgatagcagatgatggcacgaaggtcctttaggacatggcc

SEQ ID NO: 2237 - DNA, 1290 bp, synthetic construct
  misc_feature 1..1290: note = Synthetic polypeptide
  source 1..1290: mol_type = other DNA
atgcagccccgccgcgcccaggcgcccggtgcgcagctgctgcccgcgctggccctgctgctgctgctgctcggagcggggccccgaggcagctccctggccaacccggtgcccgccgcgcccctgtctgcgcccgggccgtgcgccgcgcagccctgccggaatgggggtgtgtgcacctcgcgccctgagccggacccgcagcacccggcccccgccggcgagcctggctacagctgcacctgccccgccgggatctccggcgccaactgccagcttgttgcagatccttgtgccagcaacccttgtcaccatggcaactgcagcagcagcagcagcagcagcagcgatggctacctctgcatttgcaatgaaggctatgaaggtcccaactgtgaacaggcacttcccagtctcccagccactggctggaccgaatccatggcaccccgacagcttcagcctgttcctgctactcaggagcctgacaaaatcctgcctcgctctcaggcaacggtgacactgcctacctggcagccgaaaacagggcagaaagttgtagaaatgaaatgggatcaagtggaggtgatcccagatattgcctgtgggaatgccagttctaacagctctgcgggtggccgcctggtatcctttgaagtgccacagaacacctcagtcaagattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggttttgtgaatgattctgtgactaagtctattgtggctttgcgcttaactctggtggtgaaggtcagcacctgtgtgccgggggagagtcacgcaaatgacttggagtgttcaggaaaaggaaaatgcaccacgaagccgtcagaggtgcagtggctcacgcctgtaatcccagcactttgggaggctgaagctggcggatcacctgaggtcagtagttcgagaccagcctggccaacatggtgaaaccctgtctctactaaaaatacaaaaaattagccaggcgtggtggtgggcacctgtaatcccagctactcgggaggctgaggcaggagaaatgcttgaatccagaaggcggaggttgcagtgagccaagattgtgccattggcctccagcctgggcaacaagagctgaactctatctcaaaaaataaataaataaaa

SEQ ID NO: 2238 - DNA, 4039 bp, synthetic construct
  misc_feature 1..4039: note = Synthetic polypeptide
  source 1..4039: mol_type = other DNA
atgactgaggctctccaatgggccagatatcactggcgacggctgatcagaggtgcaaccagggatgatgattcagggccatacaactattcctcgttgctcgcctgtgggcgcaagtcctctcagacccctaaactgtcaggaaggcaccggattgttgttccccacatccagcccttcaaggatgagtatgagaagttctccggagcctatgtgaacaatcgaatacgaacaacaaagtacacacttctgaattttgtgccaagaaatttatttgaacaatttcacagagctgccaatttatatttcctgttcctagttgtcctgaactgggtacctttggtagaagccttccaaaaggaaatcaccatgttgcctctggtggtggtccttacaattatcgcaattaaagatggcctggaagattatcggaaatacaaaattgacaaacagatcaataatttaataactaaagtttatagtaggaaagagaaaaaatacattgaccgatgctggaaagacgttactgttggggactttattcgcctctcctgcaacgaggtcatccctgcagacatggtactactcttttccactgatccagatggaatctgtcacattgagacttctggtcttgatggagagagcaatttaaaacagaggcaggtggttcggggatatgcagaacaggactctgaagttgatcctgagaagttttccagtaggatagaatgtgaaagcccaaacaatgacctcagcagattccgaggcttcctagaacattccaacaaagaacgcgtgggtctcagtaaagaaaatttgttgcttagaggatgcaccattagaaacacagaggctgttgtgggcattgtggtttatgcaggccatgaaaccaaagcaatgctgaacaacagtgggccacggtataagcgcagcaaattagaaagaagagcaaacacagatgtcctctggtgtgtcatgcttctggtcataatgtgcttaactggcgcagtaggtcatggaatctggctgagcaggtatgaaaagatgcattttttcaatgttcccgagcctgatggacatatcatatcaccactgttggcaggattttatatgttttggaccatgatcattttgttacaggtcttgattcctatttctctctatgtttccatcgaaattgtgaagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccaggcttttagacaaatttagtcagattacacctcggctctttatgccactagatgagaccatccaaaatccaccaatggaaactttgtacattatcgactttttcattgcattggcaatttgcaacacagtagtggtttctgctcctaaccaaccccgacaaaagatcagacacccttcactgggggggttgcccattaagtctttggaagagattaaaagtcttttccagagatggtctgtccgaagatcaagttctccatcgcttaacagtgggaaagagccatcttctggagttccaaacgcctttgtgagcagactccctctctttagtcgaatgaaaccagcttcacctgtggaggaagaggtctcccaggtgtgtgagagcccccagtgctccagtagctcagcttgctgcacagaaacagagaaacaacacggtgatgcaggcctcctgaatggcaaggcagagtccctccctggacagccattggcctgcaacctgtgttatgaggccgagagcccagacgaagcggccttagtgtatgccgccagggcttaccaatgcactttacggtctcggacaccagagcaggtcatggtggactttgctgctttgggaccattaacatttcaactcctacacatcctgccctttgactcagtaagaaaaagaatgtctgttgtggtccgacaccctctttccaatcaagttgtggtgtatacgaaaggcgctgattctgtgatcatggagttactgtcggtggcttccccagatggagcaagtctggagaaacaacagatgatagtaagggagaaaacccagaagcacttggatgactatgccaaacaaggccttcgtactttatgtatagcaaagaaggtcatgagtgacactgaatatgcagagtggctgaggaatcattttttagctgaaaccagcattgacaacagggaagaattactacttgaatctgccatgaggttggagaacaaacttacattacttggtgctactggcattgaagaccgtctgcaggagggagtccctgaatctatagaagctcttcacaaagcgggcatcaagatctggatgctgacaggggacaagcaggagacagctgtcaacatagcttatgcatgcaaactactggagccagatgacaagctttttatcctcaatacccaaagtaaagatgcctgtgggatgctgatgagcacaattttgaaagaacttcagaagaaaactcaagccctgccagagcaagtgtcattaagtgaagatttacttcagcctcctgtcccccgggactcagggttacgagctggactcattatcactgggaagaccctggagtttgccctgcaagaaagtctgcaaaagcagttcctggaactgacatcttggtgtcaagctgtggtctgctgccgagccacaccgctgcagaaaagtgaagtggtgaaattggtccgcagccatctccaggtgatgacccttgctattggtgatggtgccaatgatgttagcatgatacaagtggcagacattgggataggggtctcaggtcaagaaggcatgcaggctgtgatggccagtgactttgccgtttctcagttcaaacatctcagcaagctccttcttgtccatggacactggtgttatacacggctttccaacatgattctctattttttctataagaatgtggcctatgtgaacctccttttctggtaccagttcttttgtggattttcaggaacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggcatacttaccccataccttctggatcaccttattggatgctttttatcaaagcctggtctgcttctttgtgccttattttacctaccagggctcagatactgacatctttgcatttggaaaccccctgaacacagccgctctgttcatcgttctcctccatctggtcattgaaagcaagagtttgaccaggtgcagtgactcacacctgcaattccagagctttgggaggctgtggatcacatgaagctaagagttcaagaccagcctgggcaacatagtgagaccctgtctctaaaaaaaataacaaaactaactgtgtgtcatggcacctgccagcagtcttggccacttgggagactgaggaggaggctcacttgagcccaacagttggaggctgcagtaagctatgatcatgccactgcactccagcttgggaaacagagagaaaccttgtctctaaaaacaaaaaa

SEQ ID NO: 2239 - DNA, 578 bp, synthetic construct
  misc_feature 1..578: note = Synthetic polypeptide
  source 1..578: mol_type = other DNA
atgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagccatgattgtaagtttcctgagacctctccagccatgcagaactgtgagtcaattaaacctcttttgtttatgtattacccagtctcaggtaatgtctttatagcagtgtgaaaatgaactaataca

SEQ ID NO: 2240 - DNA, 276 bp, synthetic construct; identical to SEQ ID NO: 923
  misc_feature 1..276: note = Synthetic polypeptide
  source 1..276: mol_type = other DNA

SEQ ID NO: 2241 - DNA, 2721 bp, synthetic construct; identical to SEQ ID NO: 962
  misc_feature 1..2721: note = Synthetic polypeptide
  source 1..2721: mol_type = other DNA

SEQ ID NO: 2242 - DNA, 2549 bp, synthetic construct; identical to SEQ ID NO: 963
  misc_feature 1..2549: note = Synthetic polypeptide
  source 1..2549: mol_type = other DNA

SEQ ID NO: 2243 - DNA, 669 bp, synthetic construct; identical to SEQ ID NO: 1845
  misc_feature 1..669: note = Synthetic polypeptide
  source 1..669: mol_type = other DNA

SEQ ID NO: 2244 - DNA, 993 bp, synthetic construct
  misc_feature 1..993: note = Synthetic polypeptide
  source 1..993: mol_type = other DNA
atgcccctgctgcccgcggcgctcaccagcagcatgctctatttccagatggtgatcatggcagggacggtgatgctggcgtactacttcgagtatacggacacgttcaccgtgaacgtgcagggcttcttctgccacgacagcgcctaccgcaaaccctacccgggcccggaggacagcagcgccgtgccccccgtgctcctctactcgctggccgccggggtccccgtgctcgtgataatagttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgaccatgtacatcaccaacacaatcaaagccaagggaaccagacttgctaagccagttctatgcttgggcttaatgtgtttggcatttcttactggactcaacagagtagcagaatatcgaaatcattggtcagatgttatagcaggctttctggttggaatatctatagcagtatttctggttgtgtgcgtggtgaataatttcaaagggagacaagcagaaaatgagcatatacacatggataatctggcacagatgccaatgatcagcattcctcgagtagaaagtcctttggaaaaggtaacatctgtacaggaattccagaatagctaaataattacttgtccatggtactttggagagaattcaagcatt

SEQ ID NO: 2245 - DNA, 645 bp, synthetic construct; identical to SEQ ID NO: 137
  misc_feature 1..645: note = Synthetic polypeptide
  source 1..645: mol_type = other DNA

SEQ ID NO: 2246 - DNA, 483 bp, synthetic construct
  misc_feature 1..483: note = Synthetic polypeptide
  source 1..483: mol_type = other DNA
atggaacatctaaaggcctttgatgatgaaatcaatgcttttttggacaatatgtttggaccgcgagattctcgagtcagagggtggttcatgttggactcttaccttcctaccttttttcttactgtcatgtatctgctctcaatatggctgggtaacaagtatatgaagaacagacctgctctttctctcaggggtatcctcaccttgtataatcttggaatcacacttctctccgcgtacatgctggcagagctcattctctccacttgggaaggaggctacaacttacagtgtcaagatcttaccagcgcaggggaagctgacatccggaggaccaactgaataaaccacagcacatccacgtagcagatgcctctaccaagtggagtgaggaagagctctataccgctacagaattgtctctgggatatagttacatgaacaaaagcaacttgcagaccgtgtttataggatagcacc

SEQ ID NO: 2247 - DNA, 3516 bp, synthetic construct
  misc_feature 1..3516: note = Synthetic polypeptide
  source 1..3516: mol_type = other DNA
atgccagaacccactaagaaagaggactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2248 - DNA, 3648 bp, synthetic construct
  misc_feature 1..3648: note = Synthetic polypeptide
  source 1..3648: mol_type = other DNA
atgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2249 - DNA, 3555 bp, synthetic construct
  misc_feature 1..3555: note = Synthetic polypeptide
  source 1..3555: mol_type = other DNA
atgccagaacccactaagaaagaggatgaagaggaagtctccccgcctagcgccttgcctccagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2250 - DNA, 3552 bp, synthetic construct
  misc_feature 1..3552: note = Synthetic polypeptide
  source 1..3552: mol_type = other DNA
atgccagaacccactaagaaagaggaaaatgaagtgccagccccagccccacccccggaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2251 - DNA, 3669 bp, synthetic construct
  misc_feature 1..3669: note = Synthetic polypeptide
  source 1..3669: mol_type = other DNA
atgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2252 - DNA, 3687 bp, synthetic construct
  misc_feature 1..3687: note = Synthetic polypeptide
  source 1..3687: mol_type = other DNA
atgccagaacccactaagaaagaggaaaatgaagtgccagccccagccccacccccggaagaaccaagtaaagagaaggaggccggaactacaccagcaaaagatgaagaggaagtctccccgcctagcgccttgcctccagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2253 - DNA, 3594 bp, synthetic construct
  misc_feature 1..3594: note = Synthetic polypeptide
  source 1..3594: mol_type = other DNA
atgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2254 - DNA, 3537 bp, synthetic construct
  misc_feature 1..3537: note = Synthetic polypeptide
  source 1..3537: mol_type = other DNA
atgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2255 - DNA, 3558 bp, synthetic construct
  misc_feature 1..3558: note = Synthetic polypeptide
  source 1..3558: mol_type = other DNA
atgccagaacccactaagaaagaggaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2256 - DNA, 3297 bp, synthetic construct
  misc_feature 1..3297: note = Synthetic polypeptide
  source 1..3297: mol_type = other DNA
atggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2257 - DNA, 1071 bp, synthetic construct
  misc_feature 1..1071: note = Synthetic polypeptide
  source 1..1071: mol_type = other DNA
atggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagcctggacgagctgctggaaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtgaatgtcgtgtcctgaagtcatcttattctcgatcctcagctgttaagtattctggatccaaaagccctgggccctctcgacgcagcaaatcaccagcttcagttaatggaactcccagcagccaactttctactcctaaatctacgaaatcctccagttcctctccaactagtccaggaagtttcagaggattaaagaaaatgtttctgacc

SEQ ID NO: 2258 - DNA, 1122 bp, synthetic construct
  misc_feature 1..1122: note = Synthetic polypeptide
  source 1..1122: mol_type = other DNA
atggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagcctggacgagctgctggaaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtgaatgtcgtgtcctgaagtcatcttattctcgatcctcagctgttaagtattctggatccaaaagccctgggccctctcgacgcagcaaatcaccagcttcagtaaagcggggtggccactactccagtgcctattctacagccaaatccccagttaatggaactcccagcagccaactttctactcctaaatctacgaaatcctccagttcctctccaactagtccaggaagtttcagaggattaaagaaaatgtttctgacc

SEQ ID NO: 2259 - DNA, 180 bp, synthetic construct
  misc_feature 1..180: note = Synthetic polypeptide
  source 1..180: mol_type = other DNA
atgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtatattgactcttttcgccgaca

SEQ ID NO: 2260 - DNA, 5958 bp, synthetic construct
  misc_feature 1..5958: note = Synthetic polypeptide
  source 1..5958: mol_type = other DNA
atggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcagaccaagctttttcccatcttcccacaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggattgaggccatcaagctacagatgatcttacaaatggaaccccaaatgagctcaactaacaacttctactgaggacccctggaccaacctgctggccctttcactggcctaaagagttcccctctggaggacaccacaactgcagggccccttcttcgcccctatccagcaggaagtagctagagcggtcatcgcccaattcccaacagcagttggggtgtcctgtttagatgggggat

SEQ ID NO: 2261 - DNA, 5904 bp, synthetic construct
  misc_feature 1..5904: note = Synthetic polypeptide
  source 1..5904: mol_type = other DNA
atggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccaggagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggattgaggccatcaagctacagatgatcttacaaatggaaccccaaatgagctcaactaacaacttctactgaggacccctggaccaacctgctggccctttcactggcctaaagagttcccctctggaggacaccacaactgcagggccccttcttcgcccctatccagcaggaagtagctagagcggtcatcgcccaattcccaacagcagttggggtgtcctgtttagatgggggat

SEQ ID NO: 2262 - DNA, 4677 bp, synthetic construct
  misc_feature 1..4677: note = Synthetic polypeptide
  source 1..4677: mol_type = other DNA
atggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccatctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggattgaggccatcaagctacagatgatcttacaaatggaaccccaaatgagctcaactaacaacttctactgaggacccctggaccaacctgctggccctttcactggcctaaagagttcccctctggaggacaccacaactgcagggccccttcttcgcccctatccagcaggaagtagctagagcggtcatcgcccaattcccaacagcagttggggtgtcctgtttagatgggggat

SEQ ID NO: 2263 - DNA, 6018 bp, synthetic construct
  misc_feature 1..6018: note = Synthetic polypeptide
  source 1..6018: mol_type = other DNA
atggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcagaaacctttgaaagcactccgattcgaggagccctgcagattgaaagcagtgaggaaaccgaccagggcaaatatgagtgtgtggccaccaacagcgccggcgtgcgctactcctcacctgccaacctctacgtgcgagagcttcgagaagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggattgaggccatcaagctacagatgatcttacaaatggaaccccaaatgagctcaactaacaacttctactgaggacccctggaccaacctgctggccctttcactggcctaaagagttcccctctggaggacaccacaactgcagggccccttcttcgcccctatccagcaggaagtagctagagcggtcatcgcccaattcccaacagcagttggggtgtcctgtttagatgggggat

SEQ ID NO: 2264 - DNA, 6021 bp, synthetic construct
  misc_feature 1..6021: note = Synthetic polypeptide
  source 1..6021: mol_type = other DNA
atggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgacgttcagaaacctttgaaagcactccgattcgaggagccctgcagattgaaagcagtgaggaaaccgaccagggcaaatatgagtgtgtggccaccaacagcgccggcgtgcgctactcctcacctgccaacctctacgtgcgagagcttcgagaagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaagaagccccatagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggattgaggccatcaagctacagatgatcttacaaatggaaccccaaatgagctcaactaacaacttctactgaggacccctggaccaacctgctggccctttcactggcctaaagagttcccctctggaggacaccacaactgcagggccccttcttcgcccctatccagcaggaagtagctagagcggtcatcgcccaattcccaacagcagttggggtgtcctgtttagatgggggat

SEQ ID NO: 2265 - DNA, 316 bp, synthetic construct
  misc_feature 1..316: note = Synthetic polypeptide
  source 1..316: mol_type = other DNA
atgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagtgagctccagtgctgtgaatctctgcttaaagcaccatatgacatt

SEQ ID NO: 2266 - DNA, 441 bp, synthetic construct
  misc_feature 1..441: note = Synthetic polypeptide
  source 1..441: mol_type = other DNA
atgaacgcccctccagccttcgagtcgttcttgctcttcgagggcgagaagatcaccattaacaaggacaccaaggtacccaaggcctgcttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggtttcctgaggcctccccagccacgcttcctgtacagcctgcagaactgtgagtcaattaaacctcttttcttcataaattacccagtttctcatagttctttatagcagtgtgaaaacagactaat

SEQ ID NO: 2267 - DNA, 978 bp, synthetic construct
  misc_feature 1..978: note = Synthetic polypeptide
  source 1..978: mol_type = other DNA
atgcccctgctgcccgcggcgctcaccagcagcatgctctatttccagatggtgatcatggcagggacggtgatgctggcgtactacttcgagtatacggacacgttcaccgtgaacgtgcagggcttcttctgccacgacagcgcctaccgcaaaccctacccgggcccggaggacagcagcgccgtgccccccgtgctcctctactcgctggccgccggggtccccgtgctcgtgataatagttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgaccatgtacatcaccaacacaatcaaagccaagggaaccagacttgctaagccagttctatgcttgggcttaatgtgtttggcatttcttactggactcaacagagtagcagaatatcgaaatcattggtcagatgttatagcaggctttctggttggaatatctatagcagtatttctggttgtgtgcgtggtgaataatttcaaagggagacaagcagaaaatgagcatatacacatggataatctggcacagatgccaatgatcagcattcctcgagtagaaagtcctttggaaaaggaattccagaatagctaaataattacttgtccatggtactttggagagaattcaagcatt

SEQ ID NO: 2268 - DNA, 353 bp, synthetic construct
  misc_feature 1..353: note = Synthetic polypeptide
  source 1..353: mol_type = other DNA
atggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaaggccccaggagatgaggaagcccaggtggagaacctcatcaccgccaatgcaacagagccccagaaagcagagaactgaagtgcagccatcaggtggaagggtcaaagtgatacaatggacatcgaagcaccgtgacaattctccatgtagccattatgctataaatgttggcatcactat

SEQ ID NO: 2269 - DNA, 340 bp, synthetic construct
  misc_feature 1..340: note = Synthetic polypeptide
  source 1..340: mol_type = other DNA
atggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgcaacagagccccagaaagcagagaactgaagtgcagccatcaggtggaagggtcaaagtgatacaatggacatcgaagcaccgtgacaattctccatgtagccattatgctataaatgttggcatcactat

SEQ ID NO: 2270 - DNA, 362 bp, synthetic construct
  misc_feature 1..362: note = Synthetic polypeptide
  source 1..362: mol_type = other DNA
atggagttggtgctggtcttcctctgcagcctgctggcccccatggtcctggccagtgctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccagcaacagagccccagaaagcagagaactgaagtgcagccatcaggtggaagggtcaaagtgatacaatggacatcgaagcaccgtgacaattctccatgtagccattatgctataaatgttggcatcactat

SEQ ID NO: 2271 - DNA, 342 bp, synthetic construct
  misc_feature 1..342: note = Synthetic polypeptide
  source 1..342: mol_type = other DNA
atggcgctcgaccccgcagaccagcatctcagacatgtcgaaaaagatgttttgatccctaaaataatgagagaaaaggccaaagagaggtgttctgaacaagttcaagattttaccaaatgttgcaagaactctggagttcttatggtagtaaaatgccggaaagaaaattctgcattgaaagaatgtctaactgcttactcctcctttggcctgcgccttccatcatttttgcctggattattttaacagtttattggctatcttgcctctaaccttgcttgcctccttttgtcctatctgccacatgttgtcagattcatccaagacacaaaactgatc

SEQ ID NO: 2272 - DNA, 252 bp, synthetic construct
  misc_feature 1..252: note = Synthetic polypeptide
  source 1..252: mol_type = other DNA
atggcgctcgaccccgcagattttaccaaatgttgcaagaactctggagttcttatggtagtaaaatgccggaaagaaaattctgcattgaaagaatgtctaactgcttactcctcctttggcctgcgccttccatcatttttgcctggattattttaacagtttattggctatcttgcctctaaccttgcttgcctccttttgtcctatctgccacatgttgtcagattcatccaagacacaaaactgatc

SEQ ID NO: 2273 - DNA, 361 bp, synthetic construct
  misc_feature 1..361: note = Synthetic polypeptide
  source 1..361: mol_type = other DNA
cagagtaaacagtagcaccaaactgtcttcaggagcaaaccagcatctcagacatgtcgaaaaagatgttttgatccctaaaataatgagagaaaaggccaaagagaggtgttctgaacaagttcaagattttaccaaatgttgcaagaactctggagttcttatggtagtaaaatgccggaaagaaaattctgcattgaaagaatgtctaactgcttactcctcctttggcctgcgccttccatcatttttgcctggattattttaacagtttattggctatcttgcctctaaccttgcttgcctccttttgtcctatctgccacatgttgtcagattcatccaagacacaaaactgatc

SEQ ID NO: 2274 - DNA, 1055 bp, synthetic construct
  misc_feature 1..1055: note = Synthetic polypeptide
  source 1..1055: mol_type = other DNA
atgtcgtttgctgagagcgggtggcggtcggctctgcggcgccgcggtcccggcaccccgggccctgtggctcggccatcgtattcctcctttactcagggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggtcctctctattctctgctcgctgctcttcgccattcttctcgccttcctcctcgccatcgcctacttgatcgttaaagagttgcatgctgagaatttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagatctatccaagagaaataagtgcagattcccaccacccaccgaagacgtgttcatagtacctgtatgtataggagccccaaactggaaacacccatcagtagtaaaatgggtaaatacattttgctatatactgcagtagaaaagaacaaactaatactacatacaacatggatgaatctcacaaagacagtactgagcaaaagaaggcagacgcagaaaaatatttattgtatgatgccatgtagatgtagtttcaagagcaagtgaaactaatcttggtgacagccctcagtattgcagttacctcaagatctgcaggaggtaagttgaatatttaaaagggatctttttgcagtgccagaaatgttctctatctttatgtggttggtgagtatatgagagtctaccacagtaaaaatgcattgaactgtatataaatgttagacatttgcattttactggtatg

SEQ ID NO: 2275 - DNA, 1481 bp, synthetic construct
  misc_feature 1..1481: note = Synthetic polypeptide
  source 1..1481: mol_type = other DNA
atggatcccaaactcgggagaatggctgcgtccctgctggctgtgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccatcatcctggccgaactggggagcgatcccacgaaaggcaccgtgtgcttctacggccacttggacgtgcagcctgctgaccggggcgatgggtggctcacggacccctatgtgctgacggaggtagacgggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttacggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtgatgagaagctaagctgaggag

SEQ ID NO: 2276 - DNA, 1352 bp, synthetic construct
  misc_feature 1..1352: note = Synthetic polypeptide
  source 1..1352: mol_type = other DNA
atggatcccaaactcgggagaatgacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccatcatcctggccgaactggggagcgatcccacgaaaggcaccgtgtgcttctacggccacttggacgtgcagcctgctgaccggggcgatgggtggctcacggacccctatgtgctgacggaggtagacgggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttacggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtgatgagaagctaagctgaggag

SEQ ID NO: 2277 - DNA, 2267 bp, synthetic construct
  misc_feature 1..2267: note = Synthetic polypeptide
  source 1..2267: mol_type = other DNA
atggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagattagaaatgatatttgccaaatttgatgaagtgcaaagttcaggcggtatgattttgagtgtctgcaaagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggagcaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggcataggggttcacacctgaaatcccagcactttgaaaggctgagctaggaggattggttgaatccagaagtttgagaccagcttggacgacatagtgagaacccatctctacaaaaaattttaaatttagctgggtgtggtggcaccgtcctatagtcccacctattctggaggctgaggtgggaggaccacttgagcctgggagattgaggctacagtgagccatgatcatgccaccgcactccagcctgggcaacagaacaagattgtgtgtcaagaaataaataaaaataaaaa

SEQ ID NO: 2278 - DNA, 2264 bp, synthetic construct
  misc_feature 1..2264: note = Synthetic polypeptide
  source 1..2264: mol_type = other DNA
atggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagattagaaatgatatttgccaaatttgatgaagtgcaaagttcaggcggtatgattttgagtgtctgcaaagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggcataggggttcacacctgaaatcccagcactttgaaaggctgagctaggaggattggttgaatccagaagtttgagaccagcttggacgacatagtgagaacccatctctacaaaaaattttaaatttagctgggtgtggtggcaccgtcctatagtcccacctattctggaggctgaggtgggaggaccacttgagcctgggagattgaggctacagtgagccatgatcatgccaccgcactccagcctgggcaacagaacaagattgtgtgtcaagaaataaataaaaataaaaa

SEQ ID NO: 2279 - DNA, 731 bp, synthetic construct
  misc_feature 1..731: note = Synthetic polypeptide
  source 1..731: mol_type = other DNA
atgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggcataggggttcacacctgaaatcccagcactttgaaaggctgagctaggaggattggttgaatccagaagtttgagaccagcttggacgacatagtgagaacccatctctacaaaaaattttaaatttagctgggtgtggtggcaccgtcctatagtcccacctattctggaggctgaggtgggaggaccacttgagcctgggagattgaggctacagtgagccatgatcatgccaccgcactccagcctgggcaacagaacaagattgtgtgtcaagaaataaataaaaataaaaa

SEQ ID NO: 2280 - DNA, 1565 bp, synthetic construct
  misc_feature 1..1565: note = Synthetic polypeptide
  source 1..1565: mol_type = other DNA
atggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggcataggggttcacacctgaaatcccagcactttgaaaggctgagctaggaggattggttgaatccagaagtttgagaccagcttggacgacatagtgagaacccatctctacaaaaaattttaaatttagctgggtgtggtggcaccgtcctatagtcccacctattctggaggctgaggtgggaggaccacttgagcctgggagattgaggctacagtgagccatgatcatgccaccgcactccagcctgggcaacagaacaagattgtgtgtcaagaaataaataaaaataaaaa

SEQ ID NO: 2281 - DNA, 916 bp, synthetic construct; identical to SEQ ID NO: 1226
  misc_feature 1..916: note = Synthetic polypeptide
  source 1..916: mol_type = other DNA

SEQ ID NO: 2282 - DNA, 1898 bp, synthetic construct
  misc_feature 1..1898: note = Synthetic polypeptide
  source 1..1898: mol_type = other DNA
atggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggacttcctgtatgtcacacccacgcctctgcaggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacgggatgtggcaaactcagttgaggccagatgtg

SEQ ID NO: 2283 - DNA, 1865 bp, synthetic construct
  misc_feature 1..1865: note = Synthetic polypeptide
  source 1..1865: mol_type = other DNA
atggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacgggatgtggcaaactcagttgaggccagatgtg

SEQ ID NO: 2284 - DNA, 764 bp, synthetic construct
  misc_feature 1..764: note = Synthetic polypeptide
  source 1..764: mol_type = other DNA
ctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacgggatgtggcaaactcagttgaggccagatgtg

SEQ ID NO: 2285 - DNA, 860 bp, synthetic construct
  misc_feature 1..860: note = Synthetic polypeptide
  source 1..860: mol_type = other DNA
ctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctcccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 2286 - DNA, 1823 bp, synthetic construct
  misc_feature 1..1823: note = Synthetic polypeptide
  source 1..1823: mol_type = other DNA
atgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctcccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 2287 - DNA, 1796 bp, synthetic construct
  misc_feature 1..1796: note = Synthetic polypeptide
  source 1..1796: mol_type = other DNA
atgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctcccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 2288 - DNA, 230 bp, synthetic construct
  misc_feature 1..230: note = Synthetic polypeptide
  source 1..230: mol_type = other DNA
atgcttctctcgttacctgccttacatcttcagacctccgaacaccatcctttcttccagctgccacacagaagatgtgccttgcttccccttcgccttctgccatgattgtaagtttcctgagacctccccagccatgcagaactgtgagtcaattaaacttttctttataatttacccagtctcaggcagttatttatacaatagctgtgtgagaacgaactaatgca

SEQ ID NO: 2289 - DNA, 235 bp, synthetic construct
  misc_feature 1..235: note = Synthetic polypeptide
  source 1..235: mol_type = other DNA
atgaaatgcttctctcgttacctgccttacatcttcagacctccgaacaccatcctttcttccagctgccacacagaagatgtgccttgcttccccttcgccttctgccatgattgtaagtttcctgagacctccccagccatgcagaactgtgagtcaattaaacttttctttataatttacccagtctcaggcagttatttatacaatagctgtgtgagaacgaactaatgca

SEQ ID NO: 2290 - DNA, 97 bp, synthetic construct
  misc_feature 1..97: note = Synthetic polypeptide
  source 1..97: mol_type = other DNA
atgtctgcagatgtctccaaggagtccgaggacaagtccgaagtcagcgacaagcaatgatggcgatgacgatcctagtcaataaaaacgggggaga

SEQ ID NO: 2291 - DNA, 2158 bp, synthetic construct
  misc_feature 1..2158: note = Synthetic polypeptide
  source 1..2158: mol_type = other DNA
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtccctcacagcttgtaaagaagcctgatatggctaaagaatgaatggaattactccagacttgaccaagtaggagtcctgattgcagctgccatgctggctggatatcactgcctggggagattaataaggcctcaggcacatggcaagcagctgtggatttggtgagtgcattccctcccatttcatttagaagatggatatggaatgattcacattcacatgggatttataatacatttattgatagcttgcatcagggctaccttaactcctcaaccttctataaatatcaccttaagagacctggacgaatcagacatcccacagaatactaaatctcttcatttcattggcaatatcacataaattgggaaggatgaacaacagcaggaaagtacgctgaattccctggcaaaacatgtgcactacagaaggtgaagataaaacttacagagcttcaagagtggccactgcagtgaagtgttatgggtccagtggttaggggcatgcagagctccccgccgccacacacacacacaaagtaaaagacacacttgcatcttgcatcctcaccagaaggaaggatgcacactaccttgtgagcctctctgggttctagcaacaccacattccacatctaagtttattgctttggctgacactctgggtgatataggaggaggccagctttgagtggggcctggactggaaaggacactgcagcagacccaggctgtggtgcagtcagtcaccatccctcagacccctggtgctggaggtggcggtctggggaaagaagcaggatggagctgaaccaagcatcagtgggaaagtcagaatgcagggcctgggatcaggagtaaggccatggagtccacagcagagaaacatgctccatgttagaagcaacttttagcatgttactggccctgataagatagaatgcttgagcataggacaccaagcaaccatgtgattccaagtgcccgtgtgtattggcttctatgtgacccatagagtcattcactggacaggcccagcggcatctatcatgagacgaaaacggtccatgtcggttgagc

SEQ ID NO: 2292 - DNA, 2176 bp, synthetic construct
  misc_feature 1..2176: note = Synthetic polypeptide
  source 1..2176: mol_type = other DNA
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcaggtggagaaggggtgaaggatagaaaaggagggagttacactcaggctgcaagcagtgacagtgcccagggctctgatgtgtccctcacagcttgtaaagaagcctgatatggctaaagaatgaatggaattactccagacttgaccaagtaggagtcctgattgcagctgccatgctggctggatatcactgcctggggagattaataaggcctcaggcacatggcaagcagctgtggatttggtgagtgcattccctcccatttcatttagaagatggatatggaatgattcacattcacatgggatttataatacatttattgatagcttgcatcagggctaccttaactcctcaaccttctataaatatcaccttaagagacctggacgaatcagacatcccacagaatactaaatctcttcatttcattggcaatatcacataaattgggaaggatgaacaacagcaggaaagtacgctgaattccctggcaaaacatgtgcactacagaaggtgaagataaaacttacagagcttcaagagtggccactgcagtgaagtgttatgggtccagtggttaggggcatgcagagctccccgccgccacacacacacacaaagtaaaagacacacttgcatcttgcatcctcaccagaaggaaggatgcacactaccttgtgagcctctctgggttctagcaacaccacattccacatctaagtttattgctttggctgacactctgggtgatataggaggaggccagctttgagtggggcctggactggaaaggacactgcagcagacccaggctgtggtgcagtcagtcaccatccctcagacccctggtgctggaggtggcggtctggggaaagaagcaggatggagctgaaccaagcatcagtgggaaagtcagaatgcagggcctgggatcaggagtaaggccatggagtccacagcagagaaacatgctccatgttagaagcaacttttagcatgttactggccctgataagatagaatgcttgagcataggacaccaagcaaccatgtgattccaagtgcccgtgtgtattggcttctatgtgacccatagagtcattcactggacaggcccagcggcatctatcatgagacgaaaacggtccatgtcggttgagc

SEQ ID NO: 2293 - DNA, 504 bp, synthetic construct
  misc_feature 1..504: note = Synthetic polypeptide
  source 1..504: mol_type = other DNA
atgaccgtggagttcgaggagtgcgtcaaggactccccgcgcttcagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagagcctggtggcgcatgcctgtaatcccagctgctagggaagctgaggcaggagaatcacttgaactcgcgaggcagagattgcggtgagccgagacagcaccattgcactccagcctgggtgacaagagcgaaactccgtctcaaaaaacaaaaaacacacaaacaa

SEQ ID NO: 2294 - DNA, 378 bp, synthetic construct
  misc_feature 1..378: note = Synthetic polypeptide
  source 1..378: mol_type = other DNA
atggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagagcctggtggcgcatgcctgtaatcccagctgctagggaagctgaggcaggagaatcacttgaactcgcgaggcagagattgcggtgagccgagacagcaccattgcactccagcctgggtgacaagagcgaaactccgtctcaaaaaacaaaaaacacacaaacaa

SEQ ID NO: 2295 - DNA, 564 bp, synthetic construct
  misc_feature 1..564: note = Synthetic polypeptide
  source 1..564: mol_type = other DNA
atgagctgccgcggacggggcgcgggcggacgatggaactccacatcctggagcaccggctgcaagttgccagcgtcgccaaggagagtatcccgctgttcacctacgggcctgatcaaacttgccttcctgttctccaagaccaggtgcaagttcttcagtctgactgagacaccagaggattacactatcattgtcgatgaggaaggattcctagagctgccctcctcggagcacctgagtgtggcggatgccacctggctggccctgaacgtggtgtccggcggtggcagcttctccagctcccagcctattggcatgaccaagatcgccaagtcagtcatcgccccactggctgaccagaacatatccgtgttcatgctgtccacgtatcagacagacttcatcctggtgaggatacaactagaagccagcagtctacaggctggaagaaggccctcaccagaacccaacccttggacttcagcctccagaactgtgagaaatacatacctgctgtttgtaagacaccagtctatggaattctgttacagtagcctgaac

SEQ ID NO: 2296 - DNA, 575 bp, synthetic construct
  misc_feature 1..575: note = Synthetic polypeptide
  source 1..575: mol_type = other DNA
atgcaccaacgaggaggtgaggagcgcctctttccggccgccatcacatctaggaaggaggagcgtctctgcccggccgcccatcgtctgagatgtggggagcgcctctgccccgccgccccgtctgggatgtgaggagcacctctgcccggccacgaccccgtctgggaggtgaggagcatctctgccccgccgccccgtctgagaagtgaggagaccctctgcccggcaaccaccccgtctgagaagtgaggagaccctccacccggcagctgccccgtctgagaaatgaggagcctctccgcccggcagccaccccgtctgggaagtgaggagcgtctccgcccggcagccaccccgtccgggagggaggtggggggggtcagcccccccgccaggccagcagccccatccgggagggaggtgggggggtcagccccacgccccgccagccgccccgtcagggagggaggtgggggggtcagccccccgccaggccagccgccccgtccgggagggaggtcggggcgtcagcctcccgcccggccagccgccccgtccgggaggtgaggggc

SEQ ID NO: 2297 - DNA, 454 bp, synthetic construct
  misc_feature 1..454: note = Synthetic polypeptide
  source 1..454: mol_type = other DNA
atgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcactttaggcggccaaggtgggcgaattacttgaggtcaggagatcgagaccagcctggccaacatggcgaaaccccgtctccactaaaagcacaaaaactagccaggcgtgatgtctggcacctgtaatcccagccactcaggaggctgaagtagaagaatcgcatgaacccagggagcggaggttgcagtgagccaagatcacgccactgtactccagcctgggtgacagattgagactctgtctcaaagaaaaaaaaaaaaaaaaagaa

SEQ ID NO: 2298 - DNA, 496 bp, synthetic construct
  misc_feature 1..496: note = Synthetic polypeptide
  source 1..496: mol_type = other DNA
atggagcagcctgaggacatggcgtcgctgagcgagttcgactccttggcgggcagcatcccggccaccaaggtggagatcaccgtgtcctgcaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacgataggcgcattcagcctgaattccaggacgggcaaacccatgccagctgtgtccaacggtggtctttggatggaaagtttgagaaccactg

SEQ ID NO: 2299 - DNA, 607 bp, synthetic construct
  misc_feature 1..607: note = Synthetic polypeptide
  source 1..607: mol_type = other DNA
atggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggattcccagaggatgacatgaagttggaagagataccatcagatgacagagttgggattcaagaagatcccagcagactagaacaatgagccaaacaagatcagaactgagtggggata

SEQ ID NO: 2300 - DNA, 577 bp, synthetic construct
  misc_feature 1..577: note = Synthetic polypeptide
  source 1..577: mol_type = other DNA
tctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggattcccagaggatgacatgaagttggaagagataccatcagatgacagagttgggattcaagaagatcccagcagactagaacaatgagccaaacaagatcagaactgagtggggata

SEQ ID NO: 2301 - DNA, 604 bp, synthetic construct
  misc_feature 1..604: note = Synthetic polypeptide
  source 1..604: mol_type = other DNA
atggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagatgatggatgtctagaaaacacccctgacactgcagagttcagtcgagagttccagttgcaccagcatctctttgatccggaacatgactatccaggcttgggcaagtggattcccagaggatgacatgaagttggaagagataccatcagatgacagagttgggattcaagaagatcccagcagactagaacaatgagccaaacaagatcagaactgagtggggata

SEQ ID NO: 2302 - DNA, 678 bp, synthetic construct
  misc_feature 1..678: note = Synthetic polypeptide
  source 1..678: mol_type = other DNA
atgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaaccattgttggtcagtctctgttacttgcaaccaaaatcatccctaactgacaca

SEQ ID NO: 2303 - DNA, 771 bp, synthetic construct
  misc_feature 1..771: note = Synthetic polypeptide
  source 1..771: mol_type = other DNA
atgggagcagcccaggggaagaagaaaacatactctcctcaggccagatttcatagtgaaaatgagaagcagagacgaaatggctcagccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaaccattgttggtcagtctctgttacttgcaaccaaaatcatccctaactgacaca

SEQ ID NO: 2304 - DNA, 762 bp, synthetic construct
  misc_feature 1..762: note = Synthetic polypeptide
  source 1..762: mol_type = other DNA
atggcgcagaggctgggcgagtgggcccgggggccctccgatgccaccgggctctaccgggctgtgctgctccggtcggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaaccattgttggtcagtctctgttacttgcaaccaaaatcatccctaactgacaca

SEQ ID NO: 2305 - DNA, 696 bp, synthetic construct
  misc_feature 1..696: note = Synthetic polypeptide
  source 1..696: mol_type = other DNA
atgaatccgccggggtccctagaggccctggacccgaacgtggacgagcacttgtccacccagattctcgcgccctcggtccactccgacaactctcaggagcgcatccaggcccggcgcctccgcatcgctgcgcgcttagaagcccggaggcggctgacctgaagatgacaaaaggccagaagactccttggcttacttcgtccgaccacccggcaccctcctcctcatgtttatggttccaacctgacaacaaccctggaccacagagacctcttcctggacgactgccaacttcaggccagtttggaccggttccctgagactgcacagatcctggacttgtgccctaagcatcacctttttgcatttatgacccaattgtagtacatttaaatgttaaatctccaccccaaagtgaacatgagtagcatattgttgtatgttccgtgcacatgtaagcctaatgcacgtgcgtaatgagttttctccgtaaatattcacaaccttctcctatatcctgtagaatatgcgtttcctacctcctcacctagcagaaatatctgccttattttctccccttcaaagcctgcttctcagtctcagttgaaagcttgcttcctgcctgcaggttgtgtcctttagaaataaagttctcttttgattttgtggattctgactctttttcagttgaca

SEQ ID NO: 2306 - DNA, 207 bp, synthetic construct
  misc_feature 1..207: note = Synthetic polypeptide
  source 1..207: mol_type = other DNA
atgaacaaaaaccagttgcgaaatggtctgaggcagagtgtggttcagcttataggtggaagggacttgccttttctcagatgagactttggactgtggacttttgagttaatgctgaaatgagttaagactttgggggcctgttgggatggcatgattggttttgaaatgtgaggacatgagatttgggaaggtccaggggcagaa

SEQ ID NO: 2307 - DNA, 522 bp, synthetic construct
  misc_feature 1..522: note = Synthetic polypeptide
  source 1..522: mol_type = other DNA
atggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagccagcttaccaaaacctgaggcagaaagtggataattttgtgtcaacacatctggacaagcaggaatggaatcctacgatgaacaaaaaccagttgcgaaatggtctgaggcagagtgtggttcagcttataggtggaagggacttgccttttctcagatgagactttggactgtggacttttgagttaatgctgaaatgagttaagactttgggggcctgttgggatggcatgattggttttgaaatgtgaggacatgagatttgggaaggtccaggggcagaa

SEQ ID NO: 2308 - DNA, 154 bp, synthetic construct
  misc_feature 1..154: note = Synthetic polypeptide
  source 1..154: mol_type = other DNA
atgagtgataaaccagacttgtcggaagtggagaagtttgacaggtcaaaactgaagaaaactaatactgaagaaaaaaatactcttccctcaaaggaaaaacttcattatgtgcgatatggcaagagagaaagtgaatacgctgatataagaa

SEQ ID NO: 2309 - DNA, 359 bp, synthetic construct
  misc_feature 1..359: note = Synthetic polypeptide
  source 1..359: mol_type = other DNA
atgatacctggaattgggacactcacccaggacacactatggtgcttcagccaagtgaaaggcactatcgagattggaaccacagaagagagacactcaggaagaagatggccatgcaactggggaggcggagaccggagtgaggcatctacaagccaaagaatgccaagattggcagcaaacaccaaaagctggaagaagcaataaaaggttctcctctacaggtttcagagggtggttgcccctgccaacaccttgatttcagacttctagtccccagaactgtgaaagaataaatgcctgtcatttaagacacctagtttgtgactttgttatggcagccctaagaaaccaacaca

SEQ ID NO: 2310 - DNA, 321 bp, synthetic construct
  misc_feature 1..321: note = Synthetic polypeptide
  source 1..321: mol_type = other DNA
atggtgcttcagccaagtgaaaggcactatcgagattggaaccacagaagagagacactcaggaagaagatggccatgcaactggggaggcggagaccggagtgaggcatctacaagccaaagaatgccaagattggcagcaaacaccaaaagctggaagaagcaataaaaggttctcctctacaggtttcagagggtggttgcccctgccaacaccttgatttcagacttctagtccccagaactgtgaaagaataaatgcctgtcatttaagacacctagtttgtgactttgttatggcagccctaagaaaccaacaca

SEQ ID NO: 2311 - DNA, 681 bp, synthetic construct; identical to SEQ ID NO: 1642
  misc_feature 1..681: note = Synthetic polypeptide
  source 1..681: mol_type = other DNA

SEQ ID NO: 2312 - DNA, 534 bp, synthetic construct; identical to SEQ ID NO: 1643
  misc_feature 1..534: note = Synthetic polypeptide
  source 1..534: mol_type = other DNA

SEQ ID NO: 2313 - DNA, 270 bp, synthetic construct; identical to SEQ ID NO: 1644
  misc_feature 1..270: note = Synthetic polypeptide
  source 1..270: mol_type = other DNA

SEQ ID NO: 2314 - DNA, 596 bp, synthetic construct; identical to SEQ ID NO: 1645
  misc_feature 1..596: note = Synthetic polypeptide
  source 1..596: mol_type = other DNA

SEQ ID NO: 2315 - DNA, 1200 bp, synthetic construct
  misc_feature 1..1200: note = Synthetic polypeptide
  source 1..1200: mol_type = other DNA
atggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggacatggatgaagctggaaaccatcattctcagcaaactatcgcaaggacaaaaaaacaaacagcgcatgttctcactcatggatgggaattgaacaatgagaacacttggacacaggaaggggaacatcacacaccggggcctgttgtggggtggggggaggggggagggatagcattaggagatatacctaatgtaaatgacgagttaatgggtgcagcacaccaacgtggcacatgtatacatatgtaacaaacctgcacgttgtgcacatgtaccctagaacttaaagtattata

SEQ ID NO: 2316 - DNA, 787 bp, synthetic construct
  misc_feature 1..787: note = Synthetic polypeptide
  source 1..787: mol_type = other DNA
atgccgctgggcctgaagcccacctgcagcgtatgcaagaccacgtcgtcctccatgtggaagaagggagcgcagggggagatcctctgccatcattgcactggccggggcggcgcgggcagcgggggcgcaggctcgggggcggctggagggactgggggcagcggcggcggcggcttcggcgcggcgaccttcgccagcacctccgccacccctccgcagagcaacgggggcgggggcggcaagcagagtaagcaggaaattcacaggaggtctgctcggctcagaaacactaaatacaaatctgctccggctgctgaaaagaaagtctccaccaaaggaaaagggagaagacatatatttaaattgaaaaatcccatcaaagctcctgagtcagtttccactataatcactgcagaatcaatcttctacaagggagtatattaccaaattggtgatgttgtttctgtgattgatgaacaagatggaaagccctactatgctcaaatcagaggttttatccaggaccagtattgcgagaagagtgcagcactgacgtggctcattcctaccctctctagccccagagaccaatttgatcccgcctcctatatcatagactgcctgcgctgctgacttaaggccccaacaccaaacacagaagcaacagccttacacagagtgttcagcaagctccaacaattgtgtaaggtaaagtttcctttatagattccttttctatatcgctcctagtggttctgtttctctgatcgaattctggctgata

SEQ ID NO: 2317 - DNA, 403 bp, synthetic construct
  misc_feature 1..403: note = Synthetic polypeptide
  source 1..403: mol_type = other DNA
atgggcgagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2318 - DNA, 688 bp, synthetic construct
  misc_feature 1..688: note = Synthetic polypeptide
  source 1..688: mol_type = other DNA
atggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2319 - DNA, 757 bp, synthetic construct
  misc_feature 1..757: note = Synthetic polypeptide
  source 1..757: mol_type = other DNA
atgggcggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2320 - DNA, 547 bp, synthetic construct
  misc_feature 1..547: note = Synthetic polypeptide
  source 1..547: mol_type = other DNA
aaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2321 - DNA, 256 bp, synthetic construct
  misc_feature 1..256: note = Synthetic polypeptide
  source 1..256: mol_type = other DNA
tttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2322 - DNA, 622 bp, synthetic construct
  misc_feature 1..622: note = Synthetic polypeptide
  source 1..622: mol_type = other DNA
atggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2323 - DNA, 343 bp, synthetic construct
  misc_feature 1..343: note = Synthetic polypeptide
  source 1..343: mol_type = other DNA
atggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2324 - DNA, 1314 bp, synthetic construct
  misc_feature 1..1314: note = Synthetic polypeptide
  source 1..1314: mol_type = other DNA
atggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaaagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggaacagaaaaccagataccacgtgttctcacttataagggggcactaaatgatgagaacacatggacacatggcggagaacaagacactggggtgtactggagggtggagggtggaggagggagaggatcaggaaacataactaatgggtactaggcttaatacctgggtgatgaaataatctgtacagcaaacccccatgacatgagtttacctatagaacaaaactgtacatgttcccctgaacttaaaataaaagttaacaaaaaaa

SEQ ID NO: 2325 - DNA, 840 bp, synthetic construct; identical to SEQ ID NO: 1937
  misc_feature 1..840: note = Synthetic polypeptide
  source 1..840: mol_type = other DNA

SEQ ID NO: 2326 - DNA, 1673 bp, synthetic construct
  misc_feature 1..1673: note = Synthetic polypeptide
  source 1..1673: mol_type = other DNA
atggcgcggggggacgccggccgcggccgcgggctcctcgcgttgaccttctgcctgttggccgcgcgcggggagctgctgttgccccaggagacgactgtggagctgagctgtggagtggggccactgcaagtgatcctgggcccagagcaggctgcagtgctaaactgtagcctgggggctgctgccgctggaccccccaccagggtgacctggagcaaggatggggacaccctgctggagcacgaccacttacacctgctgcccaatggttccctgtggctgtcccagccactagcacccaatggcagtgacgagtcagtccctgaggctgtgggggtcattgaaggcaactattcgtgcctagcccacggccccctcggagtgctggccagccagactgctgtcgtcaagcttgccacactcgcagacttctctctgcacccggagtctcagacggtggaggagaacgggacagctcgctttgagtgccacattgaagggctgccagctcccatcattacttgggagaaggaccaggtgacattgcctgaggagcctcggctcatcgtgcttcccaacggcgtccttcagatcctggatgttcaggagagtgatgcaggcccctaccgctgcgtggccaccaactcagctcgccagcacttcagccaggaggccctactcagtgtggcccacagagggtccctggcgtccaccagggggcaggacgtggtcattgtggcagccccagagaacaccacagtggtgtctggccagagtgtggtgatggaatgtgtggcctcagctgaccccaccccttttgtgtcctgggtccgacaagacgggaagcccatctccacagatgtcatcgtcctgggccgcaccaacctactaattgccaacgcgcagccctggcactccggcgtctatgtctgccgcgccaacaagccccgcacgcgcgacttcgccactgcagccgctgagctccgtgtgctggcggctcccgccatcactcaggcgcccgaggcgctgtcgcggacgcgggcgagcacagcgcgcttcgtgtgccgcgcgtcgggggagccgcggccagcgctgcgctggctgcacaacggggcgccgctgcggcccaacgggcgcgtcaaggtccagggcggcggtggcagcctggtcatcacacagatcggcctgcaggacgccggctactaccagtgcgtggctgagaacagcgcgggaatggcgtgcgctgccgcgtcgctggccgtggtggtgcgcgaggggctgcccagcgcccccacgcgggtcactgctacgccactgagcagctccgctgtgttggtggcctgggagcggcccgagatgcacagcgagcagatcatcggcttctctctccactaccagaaggcacggggcatggacaatgtggaataccagtttgcagtgaacaacgacaccacagaactacaggttcgggacctggaacccaacacagattatgagttctacgtggtggcctactcccagctgggagccagccgcacctccaccccagcactggtgcacacactggatgatgatcctggtcctggcctacttctgacttgctgtgtgacccaggcaagtctctgaccgctcccgagcctcaccttccacgtcggtggagcagagctcat

SEQ ID NO: 2327 - DNA, 3220 bp, synthetic construct; identical to SEQ ID NO: 248
  misc_feature 1..3220: note = Synthetic polypeptide
  source 1..3220: mol_type = other DNA

SEQ ID NO: 2328 - DNA, 651 bp, synthetic construct
  misc_feature 1..651: note = Synthetic polypeptide
  source 1..651: mol_type = other DNA
atggaacagcctgggcccagggctccggatccctctctctgccaccacaacctccagccaacagatgaccccaactgggattcctatgctaccactatgaggactgcattcacgcctaaaacaggagcagtgcctgccttaattcgccaaaacggtatcagaagattaggatatacatattcacttagtgatcctattctcaatcagacacaatatagtgatgagtacacttggaaatcacactctaaagaagatttgatcaaaactgagacttcaagaggaatcaagagccacaaatctcatctcaatgaagacattttcctgtggacactacctcactgtcaacaaacggggacactaaagaactgcctcccttggaaaatcccggcttcaatgaaagaagttaacaaggcactatcaaatcagtttatttcccttactaagagagactttgtggacagatcaaaagaaatcctggatgctagaagacatttggaaaaatgtgttgaagggaagtgatttccaacctaaaattctatatccagccaaactatcaagcaagtctaatgaagaaaaaaagacatttccagattgacaagaatatactttcaaaagttcctccaacacaccctttcttaggaagctactgga

SEQ ID NO: 2329 - DNA, 1150 bp, synthetic construct
  misc_feature 1..1150: note = Synthetic polypeptide
  source 1..1150: mol_type = other DNA
atgctggtgccgctagccaagctgtcctgcctggcatatcagtgctttcatgccttaaaaattaagaaaaattatctacctctatgtgctacaagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcaggaagagtgagagggaaaggatgcagtccaagtgg

SEQ ID NO: 2330 - DNA, 1009 bp, synthetic construct
  misc_feature 1..1009: note = Synthetic polypeptide
  source 1..1009: mol_type = other DNA
atgctggtgccgctagccaagctgtcctgcctgggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcaggaagagtgagagggaaaggatgcagtccaagtgg

SEQ ID NO: 2331 - DNA, 451 bp, synthetic construct; identical to SEQ ID NO: 339
  misc_feature 1..451: note = Synthetic polypeptide
  source 1..451: mol_type = other DNA

SEQ ID NO: 2332 - DNA, 569 bp, synthetic construct; identical to SEQ ID NO: 1768
  misc_feature 1..569: note = Synthetic polypeptide
  source 1..569: mol_type = other DNA

SEQ ID NO: 2333 - DNA, 497 bp, synthetic construct; identical to SEQ ID NO: 1769
  misc_feature 1..497: note = Synthetic polypeptide
  source 1..497: mol_type = other DNA

SEQ ID NO: 2334 - DNA, 976 bp, synthetic construct
  misc_feature 1..976: note = Synthetic polypeptide
  source 1..976: mol_type = other DNA
atgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggcctgggaaacaagagcgaaattctgtctcaaaaaaaagacaa

SEQ ID NO: 2335 - DNA, 1009 bp, synthetic construct
  misc_feature 1..1009: note = Synthetic polypeptide
  source 1..1009: mol_type = other DNA
atggaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggcctgggaaacaagagcgaaattctgtctcaaaaaaaagacaa

SEQ ID NO: 2336 - DNA, 1132 bp, synthetic construct
  misc_feature 1..1132: note = Synthetic polypeptide
  source 1..1132: mol_type = other DNA
atgcaggtttgcagccagccccaaagggggtgtgtgcgcgagcagagcgctataaatacggcgcctcccagtgcccacaacgcggcgtcgccaggaggagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggcctgggaaacaagagcgaaattctgtctcaaaaaaaagacaa

SEQ ID NO: 2337 - DNA, 563 bp, synthetic construct
  misc_feature 1..563: note = Synthetic polypeptide
  source 1..563: mol_type = other DNA
ccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggcctgggaaacaagagcgaaattctgtctcaaaaaaaagacaa

SEQ ID NO: 2338 - DNA, 387 bp, synthetic construct
  misc_feature 1..387: note = Synthetic polypeptide
  source 1..387: mol_type = other DNA
atgcggcgaggctggaagatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagggaaaggaaatctggacacagataggtacagaaggaagaccatgtgaagacacagggagaagatgactatctacatgccaaggagagaggccttcaaaatggccaatcctgctgacacttttatcttggacttctaacctccagaattgtgagacaataaatttctgccatttagagacccagtctgtgttactttattatggcagccctagcaaactgataca

SEQ ID NO: 2339 - DNA, 1358 bp, synthetic construct
  misc_feature 1..1358: note = Synthetic polypeptide
  source 1..1358: mol_type = other DNA
atggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcgggggtaggagggggtttatttgggggcgacgaagaggtgtggagttagataggggcagtggtcgcacagcactgtgtgtgcaggcgctactgaagtgcacgctttaacatggctaacatggtgaacttca

SEQ ID NO: 2340 - DNA, 1332 bp, synthetic construct
  misc_feature 1..1332: note = Synthetic polypeptide
  source 1..1332: mol_type = other DNA
atgggcgagaccatgtcaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccacggatgagcccggcctcccttttcatcaggacgggaagatcattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcaggaagctactggagtgtggtgtctaccacaacaagggagtactctaagaaggaggatcagatccagggaagaggggctcccatacaagacaggggagcagaatccccaggaagttgacaggtgcaagtcccaggacagcagtgtcacagaagacctggaaagcagccaattatggagagtcgcctccagggaaagcaaagtcatagtagatttgaccatgtggaaaatcttatcgagagactttttacagagctgttggtgggtatgaaaaagcttaggtactggtttaaagaaaactaagcaaataaaatgtgagaaagttactccaggaaaaactaaaaggtgtaaaagaatatctgtaattcagtgtatttcctgtttcaggagcaaacaatatttgcatagtatagtctgtaaagaacacaggattatggatggtgaccagagtgaaactaaaaatggtgaccagagtgaaattctcttgggaagatcagaggaaggaaagtgt

SEQ ID NO: 2341 - DNA, 501 bp, synthetic construct
  misc_feature 1..501: note = Synthetic polypeptide
  source 1..501: mol_type = other DNA
atggaagagcctgcagctccctcagaagcccacgaggcagccggggcccaggcaggtgctgaggcagcaagggagggtgtgtctgggccggaccttcccgtctgtgagccctccggggaatctgctgctccagattcagccctgccacatgcggcaaggggctgggcccccttccctgtagctccagtccctgcccacctccgcagaggaggcctgaggcctgccccagcctcaggaggaggagcctggcccagtccgttgccaagccgaagcagcggcatttggacaaagcagatcatctgcaggtgaacggcatggattctgagaaccaggaagagagccaagtcataaaaggatcggtgcccgagtgagtccttgaatggttcatggaacagaacttctcagtcttcactcccctttacccatactgaagtttacatgattaatataatgtaatatataactaagccactgagatttgcgagtttctttgattgcagc

SEQ ID NO: 2342 - DNA, 1206 bp, synthetic construct; identical to SEQ ID NO: 282
  misc_feature 1..1206: note = Synthetic polypeptide
  source 1..1206: mol_type = other DNA

SEQ ID NO: 2343 - DNA, 1209 bp, synthetic construct; identical to SEQ ID NO: 281
  misc_feature 1..1209: note = Synthetic polypeptide
  source 1..1209: mol_type = other DNA

SEQ ID NO: 2344 - DNA, 1203 bp, synthetic construct; identical to SEQ ID NO: 286
  misc_feature 1..1203: note = Synthetic polypeptide
  source 1..1203: mol_type = other DNA

SEQ ID NO: 2345 - DNA, 573 bp, synthetic construct; identical to SEQ ID NO: 1369
  misc_feature 1..573: note = Synthetic polypeptide
  source 1..573: mol_type = other DNA

SEQ ID NO: 2346 - DNA, 416 bp, synthetic construct; identical to SEQ ID NO: 1370
  misc_feature 1..416: note = Synthetic polypeptide
  source 1..416: mol_type = other DNA

SEQ ID NO: 2347 - DNA, 128 bp, synthetic construct; identical to SEQ ID NO: 144
  misc_feature 1..128: note = Synthetic polypeptide
  source 1..128: mol_type = other DNA

SEQ ID NO: 2348 - DNA, 821 bp, synthetic construct
  misc_feature 1..821: note = Synthetic polypeptide
  source 1..821: mol_type = other DNA
atgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacaggaatctacttaatagggctatcatggggataaaatgagtgcatatatttaaggtaattttttaacgggtctggcacatagtaagtgctcaataaagattagcttttact

SEQ ID NO: 2349 - DNA, 656 bp, synthetic construct
  misc_feature 1..656: note = Synthetic polypeptide
  source 1..656: mol_type = other DNA
atgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacaggaatctacttaatagggctatcatggggataaaatgagtgcatatatttaaggtaattttttaacgggtctggcacatagtaagtgctcaataaagattagcttttact

SEQ ID NO: 2350 - DNA, 780 bp, synthetic construct
  misc_feature 1..780: note = Synthetic polypeptide
  source 1..780: mol_type = other DNA
atgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacaggaatctacttaatagggctatcatggggataaaatgagtgcatatatttaaggtaattttttaacgggtctggcacatagtaagtgctcaataaagattagcttttact

SEQ ID NO: 2351 - DNA, 439 bp, synthetic construct
  misc_feature 1..439: note = Synthetic polypeptide
  source 1..439: mol_type = other DNA
ggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacaggaatctacttaatagggctatcatggggataaaatgagtgcatatatttaaggtaattttttaacgggtctggcacatagtaagtgctcaataaagattagcttttact

SEQ ID NO: 2352 - DNA, 917 bp, synthetic construct
  misc_feature 1..917: note = Synthetic polypeptide
  source 1..917: mol_type = other DNA
atggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctgaccccaatgatgcagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagaggattagcctgatacggtggtgcatgcctgtagttcaggctactcaggaggctgaggcgggaggatcgcttgagcctaggagttggaggctgcagtgaactatgatggtgccactgcactccagcctgggtgacagagcgagaccttatctccaaaaattaaaaaa

SEQ ID NO: 2353 - DNA, 657 bp, synthetic construct; identical to SEQ ID NO: 180
  misc_feature 1..657: note = Synthetic polypeptide
  source 1..657: mol_type = other DNA

SEQ ID NO: 2354 - DNA, 423 bp, synthetic construct; identical to SEQ ID NO: 179
  misc_feature 1..423: note = Synthetic polypeptide
  source 1..423: mol_type = other DNA

SEQ ID NO: 2355 - DNA, 415 bp, synthetic construct
  misc_feature 1..415: note = Synthetic polypeptide
  source 1..415: mol_type = other DNA
atgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccggaagaggaaatttggacacagacatgcacagacaagagggacaaccacagaaagacacagggagaagagggccatctgtgagccaaggagagaagccccaagagccaaccctaccgacaccttgatcttagacttttagcctccggaattgtgagacaatatatgtctgttgtttatgccaccgaacccacgttattttatcatggtagcccctagcaaactcat

SEQ ID NO: 2356 - DNA, 259 bp, synthetic construct
  misc_feature 1..259: note = Synthetic polypeptide
  source 1..259: mol_type = other DNA
atgtgtcagaaagaagtgatggagcaaagtgccggaagaggaaatttggacacagacatgcacagacaagagggacaaccacagaaagacacagggagaagagggccatctgtgagccaaggagagaagccccaagagccaaccctaccgacaccttgatcttagacttttagcctccggaattgtgagacaatatatgtctgttgtttatgccaccgaacccacgttattttatcatggtagcccctagcaaactcat

SEQ ID NO: 2357 - DNA, 809 bp, synthetic construct; identical to SEQ ID NO: 2110
  misc_feature 1..809: note = Synthetic polypeptide
  source 1..809: mol_type = other DNA

SEQ ID NO: 2358 - DNA, 644 bp, synthetic construct; identical to SEQ ID NO: 2111
  misc_feature 1..644: note = Synthetic polypeptide
  source 1..644: mol_type = other DNA

SEQ ID NO: 2359 - DNA, 768 bp, synthetic construct; identical to SEQ ID NO: 2112
  misc_feature 1..768: note = Synthetic polypeptide
  source 1..768: mol_type = other DNA

SEQ ID NO: 2360 - DNA, 427 bp, synthetic construct; identical to SEQ ID NO: 2113
  misc_feature 1..427: note = Synthetic polypeptide
  source 1..427: mol_type = other DNA

SEQ ID NO: 2361 - DNA, 980 bp, synthetic construct; identical to SEQ ID NO: 139
  misc_feature 1..980: note = Synthetic polypeptide
  source 1..980: mol_type = other DNA

SEQ ID NO: 2362 - DNA, 1256 bp, synthetic construct; identical to SEQ ID NO: 140
  misc_feature 1..1256: note = Synthetic polypeptide
  source 1..1256: mol_type = other DNA

SEQ ID NO: 2363 - DNA, 1277 bp, synthetic construct; identical to SEQ ID NO: 142
  misc_feature 1..1277: note = Synthetic polypeptide
  source 1..1277: mol_type = other DNA

SEQ ID NO: 2364 - DNA, 303 bp, synthetic construct; identical to SEQ ID NO: 148
  misc_feature 1..303: note = Synthetic polypeptide
  source 1..303: mol_type = other DNA

SEQ ID NO: 2365 - DNA, 301 bp, synthetic construct; identical to SEQ ID NO: 147
  misc_feature 1..301: note = Synthetic polypeptide
  source 1..301: mol_type = other DNA

SEQ ID NO: 2366 - DNA, 857 bp, synthetic construct; identical to SEQ ID NO: 1374
  misc_feature 1..857: note = Synthetic polypeptide
  source 1..857: mol_type = other DNA

SEQ ID NO: 2367 - DNA, 2849 bp, synthetic construct; identical to SEQ ID NO: 1326
  misc_feature 1..2849: note = Synthetic polypeptide
  source 1..2849: mol_type = other DNA

SEQ ID NO: 2368 - DNA, 1925 bp, synthetic construct; identical to SEQ ID NO: 1327
  misc_feature 1..1925: note = Synthetic polypeptide
  source 1..1925: mol_type = other DNA

SEQ ID NO: 2369 - DNA, 2729 bp, synthetic construct; identical to SEQ ID NO: 1328
  misc_feature 1..2729: note = Synthetic polypeptide
  source 1..2729: mol_type = other DNA

SEQ ID NO: 2370 - DNA, 2549 bp, synthetic construct; identical to SEQ ID NO: 1329
  misc_feature 1..2549: note = Synthetic polypeptide
  source 1..2549: mol_type = other DNA

SEQ ID NO: 2371 - DNA, 561 bp, synthetic construct
  misc_feature 1..561: note = Synthetic polypeptide
  source 1..561: mol_type = other DNA
atgtcgtgggttcaagcagcctccttgatccagggccctggagacaaaggggacgtgtttgacgaagaagcagacgagtcgctcctggcgcagcgggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgagctgtaacactcactgcaacgggctgcagcttcgctcctgaggccagcgagaccacgaacccattggaagaatgaacaactccagacgcgctgccttatgagctgcaacactcaccgcgaaggtctgtagcttcactcctgaagccagtgagaccatgaacccgccagaagaaagaaactccgaacacgtctgaatatcagaaggaacaacctccggacacaccacctttaagaactgtaacactcaccgcgagggtctgcagcttcattcttgaagtcagtgagaccaagaatccaccaattccggagac

SEQ ID NO: 2372 - DNA, 1052 bp, synthetic construct; identical to SEQ ID NO: 247
  misc_feature 1..1052: note = Synthetic polypeptide
  source 1..1052: mol_type = other DNA

SEQ ID NO: 2373 - DNA, 327 bp, synthetic construct; identical to SEQ ID NO: 246
  misc_feature 1..327: note = Synthetic polypeptide
  source 1..327: mol_type = other DNA

SEQ ID NO: 2374 - DNA, 7189 bp, synthetic construct
  misc_feature 1..7189: note = Synthetic polypeptide
  source 1..7189: mol_type = other DNA
atgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggctgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccctggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggaaccatgcaagaagcgcagccaccagaagtccttaaaacagcaggaaaggtgtctacggagaaataaacaagtgatgcacgacagatacatgtgtcagtctggtccctgcagttgtatttgtaataatacacattggagcaatttcatggccatcagttagagaatgtttgaggaatgatccattcata

SEQ ID NO: 2375 - DNA, 671 bp, synthetic construct
  misc_feature 1..671: note = Synthetic polypeptide
  source 1..671: mol_type = other DNA
atggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgctgttcagaggcagaggcaggagaatcatttgaatgcgggagacagaggctgcagtaagccgagatcgtgccactgcactccagcctgggtgacacagcgagactctgtctcaaaaagaaagaaagagagagagagaaa

SEQ ID NO: 2376 - DNA, 353 bp, synthetic construct
  misc_feature 1..353: note = Synthetic polypeptide
  source 1..353: mol_type = other DNA
cgcttcgccgagggcatccgccacatgaagagccggctggccgcgctgcagaactctgtgggcagggtgggcccagatgcccttccaggtatcagtgaatgctccagccagccttgtcaaaatggtggtacatgtgtagaaggagtcaaccagtacagatgcatttgtcctccaggaaggactgggaaccgctgtcagcatcaggcccagactgctgttcagaggcagaggcaggagaatcatttgaatgcgggagacagaggctgcagtaagccgagatcgtgccactgcactccagcctgggtgacacagcgagactctgtctcaaaaagaaagaaagagagagagagaaa

SEQ ID NO: 2377 - DNA, 2962 bp, synthetic construct
  misc_feature 1..2962: note = Synthetic polypeptide
  source 1..2962: mol_type = other DNA
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagagtcttcctgaaacacagctacacccgtattatccatggctgctttcctgtcacagtgagtaagtagctgggactgagaaggcatggcctccaaagtctaaaatatttactctctagcactttgtagaaaaacctta

SEQ ID NO: 2378 - DNA, 2899 bp, synthetic construct
  misc_feature 1..2899: note = Synthetic polypeptide
  source 1..2899: mol_type = other DNA
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagagtcttcctgaaacacagctacacccgtattatccatggctgctttcctgtcacagtgagtaagtagctgggactgagaaggcatggcctccaaagtctaaaatatttactctctagcactttgtagaaaaacctta

SEQ ID NO: 2379 - DNA, 2902 bp, synthetic construct
  misc_feature 1..2902: note = Synthetic polypeptide
  source 1..2902: mol_type = other DNA
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagagtcttcctgaaacacagctacacccgtattatccatggctgctttcctgtcacagtgagtaagtagctgggactgagaaggcatggcctccaaagtctaaaatatttactctctagcactttgtagaaaaacctta

SEQ ID NO: 2380 - DNA, 2839 bp, synthetic construct
  misc_feature 1..2839: note = Synthetic polypeptide
  source 1..2839: mol_type = other DNA
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagagtcttcctgaaacacagctacacccgtattatccatggctgctttcctgtcacagtgagtaagtagctgggactgagaaggcatggcctccaaagtctaaaatatttactctctagcactttgtagaaaaacctta

SEQ ID NO: 2381 - DNA, 664 bp, synthetic construct
  misc_feature 1..664: note = Synthetic polypeptide
  source 1..664: mol_type = other DNA
atggatggcatcattgaacagaagagcatgctggtgcacagtaaaatcagtgatgctggcaagaggaatggtttaattaacaccagaaacttgatggccgagagcagagatggtctggtgtctgtttacccagcgccccagtaccagagccaccgggtgggggccagcacagtgccggccagcctggacagcagcaggagtgagccgatgcagcagctgctggaccccaacaccctgcagcagtcagtggagtcccgctaccggcccaacatcatcctctattcagagggcgtgctgcgctcctggggggacggtgtggccgccgactgctgcgagaccaccttcatcgaggaccggtcgcccaccaaagacagcctcgagtacccggatgggaagttcattgacctctcagctgatgacataaaaatccacaccctgtcctacgatgtggaggaggaggaggagttccaggagctggagagcgactactcaagcgacacagagagtgaggacaatttcctcatgatgcccccgcgggaccacctgggcctcagtgtcttctccatgctctgctgcttctggcctctgggcatcgcagccttctacttgtcccatgagtgagtcgaagcagcccgaggtcctcaccatatgcagatgctcagta

SEQ ID NO: 2382 - DNA, 3733 bp, synthetic construct
  misc_feature 1..3733: note = Synthetic polypeptide
  source 1..3733: mol_type = other DNA
atgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagcctcctcccttctactcctcctccttctccttcctcttccccttgctcttcctcctcccttccactcctcctcttttctcctccccattcatctcccactcttccccctcctccctccaactcctcccctcctccttccattcatctttctcctcctttctccttcccttcctcctccctcttctctccttcctccctcccattcctctgcctcctccttccactcatcttcctcctcctttctcttccccatcctccctcccactcctccccctccttcttccactgatctttctcctcctttctcctccccctcctcctcc

SEQ ID NO: 2383 - DNA, 2086 bp, synthetic construct
  misc_feature 1..2086: note = Synthetic polypeptide
  source 1..2086: mol_type = other DNA
atgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagcctcctcccttctactcctcctccttctccttcctcttccccttgctcttcctcctcccttccactcctcctcttttctcctccccattcatctcccactcttccccctcctccctccaactcctcccctcctccttccattcatctttctcctcctttctccttcccttcctcctccctcttctctccttcctccctcccattcctctgcctcctccttccactcatcttcctcctcctttctcttccccatcctccctcccactcctccccctccttcttccactgatctttctcctcctttctcctccccctcctcctcc

SEQ ID NO: 2384 - DNA, 477 bp, synthetic construct
  misc_feature 1..477: note = Synthetic polypeptide
  source 1..477: mol_type = other DNA
agggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagcctcctcccttctactcctcctccttctccttcctcttccccttgctcttcctcctcccttccactcctcctcttttctcctccccattcatctcccactcttccccctcctccctccaactcctcccctcctccttccattcatctttctcctcctttctccttcccttcctcctccctcttctctccttcctccctcccattcctctgcctcctccttccactcatcttcctcctcctttctcttccccatcctccctcccactcctccccctccttcttccactgatctttctcctcctttctcctccccctcctcctcc

SEQ ID NO: 2385 - DNA, 585 bp, synthetic construct
  misc_feature 1..585: note = Synthetic polypeptide
  source 1..585: mol_type = other DNA
atggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcagggacaaaaaagaaagaagtttaaatggaagcaggaaaggttgagatttgggatgagaatgaactgccagaagagacagcaaaaggaccggaataag

SEQ ID NO: 2386 - DNA, 579 bp, synthetic construct
  misc_feature 1..579: note = Synthetic polypeptide
  source 1..579: mol_type = other DNA
atggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcagggacaaaaaagaaagaagtttaaatggaagcaggaaaggttgagatttgggatgagaatgaactgccagaagagacagcaaaaggaccggaataag

SEQ ID NO: 2387 - DNA, 436 bp, synthetic construct
  misc_feature 1..436: note = Synthetic polypeptide
  source 1..436: mol_type = other DNA
atgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaa

SEQ ID NO: 2388 - DNA, 454 bp, synthetic construct
  misc_feature 1..454: note = Synthetic polypeptide
  source 1..454: mol_type = other DNA
atgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaa

SEQ ID NO: 2389 - DNA, 349 bp, synthetic construct
  misc_feature 1..349: note = Synthetic polypeptide
  source 1..349: mol_type = other DNA
atgctggactgtggaatgcacatgggcttcaatgacgaccgacgcttccctgacttctcctacatcacccagaacggccgcctaacagacttcctggactgtgtgatcattagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaa

SEQ ID NO: 2390 - DNA, 577 bp, synthetic construct
  misc_feature 1..577: note = Synthetic polypeptide
  source 1..577: mol_type = other DNA
atgcctgagatcagagtcacgcccttgggtgcctgccctgtgctgtcctggaacctggtccttccaccgggcagggggtcgagggcaccttccagcacagacaccaggacgggattccatgtcctcccccatggcgtgagcgcttcctcggagggtgccccccgccccggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaa

SEQ ID NO: 2391 - DNA, 439 bp, synthetic construct
  misc_feature 1..439: note = Synthetic polypeptide
  source 1..439: mol_type = other DNA
atgcctgagatcagagtcacgcccttggtaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaa

SEQ ID NO: 2392 - DNA, 616 bp, synthetic construct
  misc_feature 1..616: note = Synthetic polypeptide
  source 1..616: mol_type = other DNA
atgcctgagatcagagtcacgcccttgggtgcctgccctgtgctgtcctggaacctggtccttccaccgggcagggggtcgagggcaccttccagcacagacaccaggacgggattccatgtcctcccccatggccccctcggctgtggccccgtcatcctgatgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaa

SEQ ID NO: 2393 - DNA, 565 bp, synthetic construct; identical to SEQ ID NO: 1420
  misc_feature 1..565: note = Synthetic polypeptide
  source 1..565: mol_type = other DNA

SEQ ID NO: 2394 - DNA, 610 bp, synthetic construct; identical to SEQ ID NO: 163
  misc_feature 1..610: note = Synthetic polypeptide
  source 1..610: mol_type = other DNA

SEQ ID NO: 2395 - DNA, 193 bp, synthetic construct; identical to SEQ ID NO: 975
  misc_feature 1..193: note = Synthetic polypeptide
  source 1..193: mol_type = other DNA

SEQ ID NO: 2396 - DNA, 822 bp, synthetic construct; identical to SEQ ID NO: 119
  misc_feature 1..822: note = Synthetic polypeptide
  source 1..822: mol_type = other DNA

SEQ ID NO: 2397 - DNA, 434 bp, synthetic construct; identical to SEQ ID NO: 992
  misc_feature 1..434: note = Synthetic polypeptide
  source 1..434: mol_type = other DNA

SEQ ID NO: 2398 - DNA, 371 bp, synthetic construct; identical to SEQ ID NO: 1008
  misc_feature 1..371: note = Synthetic polypeptide
  source 1..371: mol_type = other DNA

SEQ ID NO: 2399 - DNA, 272 bp, synthetic construct; identical to SEQ ID NO: 1009
  misc_feature 1..272: note = Synthetic polypeptide
  source 1..272: mol_type = other DNA

SEQ ID NO: 2400 - DNA, 157 bp, synthetic construct; identical to SEQ ID NO: 1500
  misc_feature 1..157: note = Synthetic polypeptide
  source 1..157: mol_type = other DNA

SEQ ID NO: 2401 - DNA, 39 bp, synthetic construct
  misc_feature 1..39: note = Synthetic polypeptide
  source 1..39: mol_type = other DNA
atggggaggcccacccagatctgaaaatgtctaatttca

SEQ ID NO: 2402 - DNA, 840 bp, synthetic construct
  misc_feature 1..840: note = Synthetic polypeptide
  source 1..840: mol_type = other DNA
atggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacaacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccaggtgtagtggtgtgtgcctacagtcccagctactcgggagactgaagtaggaggatcactgcactccagcctgagcaacagaacaagacccaatctctaacaatagtaataataa

SEQ ID NO: 2403 - DNA, 1424 bp, synthetic construct
  misc_feature 1..1424: note = Synthetic polypeptide
  source 1..1424: mol_type = other DNA
atgacggcggagaaggcgctgcccctgggcaatgggaaggctgctgaggaggcgcgggagtccgaggcgccgggtggcggctgcagcagcgggggcgcggcgcccgcgcgccacccgcgcgtcaagcgcgacaaggcggtccacgagcgcggccactggaacaacaaggtggagttcgtgctgagcgtggccggggagatcattgggctgggcaacgtgtggcgcttcccctacctgtgctacaagaacggaggaggggcattcctgattccctacgtggtgttttttatttgctgtggaattcctgtttttttcctggagacagctctggggcagttcacaagtgaaggtggcattacgtgttggaggaaagtttgccctttatttgaaggcattggctatgcaacacaggtgattgaggcccatctgaatgtgtactacatcatcatcctggcatgggccattttttacctgagcaactgcttcactactgagctaccctgggctacctgtgggcatgagtggaacacagagaattgtgtggagttccagaaactgaatgtgagcaactacagccatgtgtctctgcagaatgccacctcccctgtcatggagttttgggagcaccgggtcctggccatctctgacgggatcgagcacatcgggaaccttcgctgggagctggccttgtgtctcttggcagcctggaccatctgttacttctgtatctggaaggggaccaagtctacaggaaaggttgtatacgtgactgcgacattcccctacatcatgctgctgatcctcctgatacgaggggtcacgttgcccggggcctcagagggcatcaagttctacttgtaccctgacctctcccggctctccgacccccaggtctgggtagatgctggaacgcagatctttttctcctatgccatttgcctgggctgtctgaccgctctgggaagttataacaattataacaacaactgctacagggactgcatcatgctctgttgcctgaacagcggcaccagcttcgtggctgggtttgccatcttctcagtcctgggttttatggcgtacgagcagggggtacccattgctgaggtggcagagtcagccaaaagatgcacaacctcaccataagtcatgaggaaacatcagaccaacccacatcaagagacattctgcaaaacaacaaccagaactcatcaaaaatgttgagtttagcaaagaccaaaaaaagactaagggactgccacagactggagaagactaaagagatacaaccaataaacgcaatgtggagttctgaattaaatgttggaacagaaaaaaagggggcaaaaggagaaaaactggcagaatatgaataagctctgtggcgtaattaatggtattataccaatattaatttaccagtt

SEQ ID NO: 2404 - DNA, 1146 bp, synthetic construct; identical to SEQ ID NO: 988
  misc_feature 1..1146: note = Synthetic polypeptide
  source 1..1146: mol_type = other DNA

SEQ ID NO: 2405 - DNA, 1221 bp, synthetic construct; identical to SEQ ID NO: 122
  misc_feature 1..1221: note = Synthetic polypeptide
  source 1..1221: mol_type = other DNA

SEQ ID NO: 2406 - DNA, 1753 bp, synthetic construct
  misc_feature 1..1753: note = Synthetic polypeptide
  source 1..1753: mol_type = other DNA
atgtggcgctggatccggcagcagctgggttttgacccaccacatcagagtgacacaagaaccatctacgtagccaacaggtttcctcagaatggcctttacacacctcagaaatttatagataacaggatcatttcatctaagtacactgtgtggaattttgttccaaaaaatttatttgaacagttcagaagagtggcaaacttttattttcttattatatttttggttcagcttatgattgatacacctaccagtccagttaccagtggacttccattattctttgtgataacagtaactgccataaagcagggatatgaagattggttacggcataactcagataatgaagtaaatggagctcctgtttatgttgttcgaagtggtggccttgtaaaaactagatcaaaaaacattcgggtgggtgatattgttcgaatagccaaagatgaaatttttcctgcagacttggtgcttctgtcctcagatcgactggatggttcctgtcacgttacaactgctagtttggacggagaaactaacctgaagacacatgtggcagttccagaaacagcattattacaaacagttgccaatttggacactctagtagctgtaatagaatgccagcaaccagaagcagacttatacagattcatgggacgaatgatcataacccaacaaatggaagaaattgtaagacctctggggccggagagtctcctgcttcgtggagccagattaaaaaacacaaaagaaatttttggtgttgcggtatacactggaatggaaactaagatggcattaaattacaagagcaaatcacagaaacgatctgcagtagaaaagtccttggctgactgctagaactatacatgtgcaagggagacaaaagaactcaacagaattttactgctgcccattgcattggagacacagtttgttgaactaggtgaagttaacttcctactggaataaaaatagcactcttctgaggaacataaaagaatacagactgtctacaatgtattattatgaagtccagtctgcaataaaaaataagcagaatatgaagaaaatgtaattcatccataagataaaaagcactcaatagaaactgtctccaaaatgatccagatcttgcatttagcagacgagaactttaaagcagatattataaatttattataaacatgtttaagggcctaaaggaaaatttgaatgaacatatgggaaaacacagcagagaaatgaaaactcttgacttgaaaaacataattactaaaatggaaacatcattaggtgggtctcaacaccagactgaataaatcagaccagtgaacttgaagaaaacacaaattactcagtcgaagaatggagaggaaaaaagattaggaaaaatgaacagagcttcagagccatgtgggataatattaagctgtttggcatatgtgtaattgattcccaaaaaaagagaaaaaaggacagaataaaaatatttgaaaaaataatgactgaaaatttctaaaatttgaggaagaaacttcagcctacgctaccaagatcagcaaactctaagcaggaaaaatataaagaaatataaagaaacccacaccaaagcacatcatggtcaaaatactagaatccaaagaaaaagaaaatatttcatggagccgaagagaaatgcatcacatgtaaatgaataacaatataagcgataaccagttctcatcagaaacaacggaggaca

SEQ ID NO: 2407 - DNA, 1155 bp, synthetic construct
  misc_feature 1..1155: note = Synthetic polypeptide
  source 1..1155: mol_type = other DNA
atttggacactctagtagctgtaatagaatgccagcaaccagaagcagacttatacagattcatgggacgaatgatcataacccaacaaatggaagaaattgtaagacctctggggccggagagtctcctgcttcgtggagccagattaaaaaacacaaaagaaatttttggtgttgcggtatacactggaatggaaactaagatggcattaaattacaagagcaaatcacagaaacgatctgcagtagaaaagtccttggctgactgctagaactatacatgtgcaagggagacaaaagaactcaacagaattttactgctgcccattgcattggagacacagtttgttgaactaggtgaagttaacttcctactggaataaaaatagcactcttctgaggaacataaaagaatacagactgtctacaatgtattattatgaagtccagtctgcaataaaaaataagcagaatatgaagaaaatgtaattcatccataagataaaaagcactcaatagaaactgtctccaaaatgatccagatcttgcatttagcagacgagaactttaaagcagatattataaatttattataaacatgtttaagggcctaaaggaaaatttgaatgaacatatgggaaaacacagcagagaaatgaaaactcttgacttgaaaaacataattactaaaatggaaacatcattaggtgggtctcaacaccagactgaataaatcagaccagtgaacttgaagaaaacacaaattactcagtcgaagaatggagaggaaaaaagattaggaaaaatgaacagagcttcagagccatgtgggataatattaagctgtttggcatatgtgtaattgattcccaaaaaaagagaaaaaaggacagaataaaaatatttgaaaaaataatgactgaaaatttctaaaatttgaggaagaaacttcagcctacgctaccaagatcagcaaactctaagcaggaaaaatataaagaaatataaagaaacccacaccaaagcacatcatggtcaaaatactagaatccaaagaaaaagaaaatatttcatggagccgaagagaaatgcatcacatgtaaatgaataacaatataagcgataaccagttctcatcagaaacaacggaggaca

SEQ ID NO: 2408 - DNA, 4039 bp, synthetic construct; identical to SEQ ID NO: 2238
  misc_feature 1..4039: note = Synthetic polypeptide
  source 1..4039: mol_type = other DNA

SEQ ID NO: 2409 - DNA, 15330 bp, synthetic construct; identical to SEQ ID NO: 1467
  misc_feature 1..15330: note = Synthetic polypeptide
  source 1..15330: mol_type = other DNA

SEQ ID NO: 2410 - DNA, 15330 bp, synthetic construct; identical to SEQ ID NO: 1468
  misc_feature 1..15330: note = Synthetic polypeptide
  source 1..15330: mol_type = other DNA

SEQ ID NO: 2411 - DNA, 15345 bp, synthetic construct; identical to SEQ ID NO: 1469
  misc_feature 1..15345: note = Synthetic polypeptide
  source 1..15345: mol_type = other DNA

SEQ ID NO: 2412 - DNA, 881 bp, synthetic construct
  misc_feature 1..881: note = Synthetic polypeptide
  source 1..881: mol_type = other DNA
atggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccagggacatggatgaaactggaaaccatcattttcagcaaactatcgcaaggacaaaaaaaaccaaacaccacatgttctcactcatagtgggaattgaacaatgagaacacatggacacaggaaggggaacatcacacaccggggcctgttgtggtgtggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaa

SEQ ID NO: 2413 - DNA, 803 bp, synthetic construct
  misc_feature 1..803: note = Synthetic polypeptide
  source 1..803: mol_type = other DNA
atggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccagggacatggatgaaactggaaaccatcattttcagcaaactatcgcaaggacaaaaaaaaccaaacaccacatgttctcactcatagtgggaattgaacaatgagaacacatggacacaggaaggggaacatcacacaccggggcctgttgtggtgtggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaa

SEQ ID NO: 2414 - DNA, 603 bp, synthetic construct; identical to SEQ ID NO: 1012
  misc_feature 1..603: note = Synthetic polypeptide
  source 1..603: mol_type = other DNA

SEQ ID NO: 2415 - DNA, 534 bp, synthetic construct
  misc_feature 1..534: note = Synthetic polypeptide
  source 1..534: mol_type = other DNA
cggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattataggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2416 - DNA, 542 bp, synthetic construct
  misc_feature 1..542: note = Synthetic polypeptide
  source 1..542: mol_type = other DNA
atgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2417 - DNA, 1403 bp, synthetic construct
  misc_feature 1..1403: note = Synthetic polypeptide
  source 1..1403: mol_type = other DNA
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2418 - DNA, 491 bp, synthetic construct
  misc_feature 1..491: note = Synthetic polypeptide
  source 1..491: mol_type = other DNA
atgctcggaataacttcctgcagcgaccaacaggctaaagagggggaaggtctggagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2419 - DNA, 578 bp, synthetic construct
  misc_feature 1..578: note = Synthetic polypeptide
  source 1..578: mol_type = other DNA
atgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgaggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2420 - DNA, 1280 bp, synthetic construct
  misc_feature 1..1280: note = Synthetic polypeptide
  source 1..1280: mol_type = other DNA
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2421 - DNA, 1370 bp, synthetic construct
  misc_feature 1..1370: note = Synthetic polypeptide
  source 1..1370: mol_type = other DNA
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2422 - DNA, 692 bp, synthetic construct
  misc_feature 1..692: note = Synthetic polypeptide
  source 1..692: mol_type = other DNA
atgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2423 - DNA, 431 bp, synthetic construct
  misc_feature 1..431: note = Synthetic polypeptide
  source 1..431: mol_type = other DNA
tccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2424 - DNA, 344 bp, synthetic construct
  misc_feature 1..344: note = Synthetic polypeptide
  source 1..344: mol_type = other DNA
atgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2425 - DNA, 1553 bp, synthetic construct
  misc_feature 1..1553: note = Synthetic polypeptide
  source 1..1553: mol_type = other DNA
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2426 - DNA, 1493 bp, synthetic construct
  misc_feature 1..1493: note = Synthetic polypeptide
  source 1..1493: mol_type = other DNA
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattataggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2427 - DNA, 638 bp, synthetic construct
  misc_feature 1..638: note = Synthetic polypeptide
  source 1..638: mol_type = other DNA
atgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2428 - DNA, 1439 bp, synthetic construct
  misc_feature 1..1439: note = Synthetic polypeptide
  source 1..1439: mol_type = other DNA
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgaggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2429 - DNA, 1352 bp, synthetic construct
  misc_feature 1..1352: note = Synthetic polypeptide
  source 1..1352: mol_type = other DNA
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2430 - DNA, 602 bp, synthetic construct
  misc_feature 1..602: note = Synthetic polypeptide
  source 1..602: mol_type = other DNA
atgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2431 - DNA, 8674 bp, synthetic construct
  misc_feature 1..8674: note = Synthetic polypeptide
  source 1..8674: mol_type = other DNA
atggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactccaatttggggtattgccaatgcaagcttcatgttgaaggtcctacttgtagccgctgcaaactgttatattggaatctggacaaagaaaaccccagtggatgttcagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtaccctggcttgtgaggccagacacttcctgcttgatggggagccaagacccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctgcatcaagtttgtatcatacctattgaagaattctcagctgagtatgtgagaccacaagtccactgcattgccagttatgggcgatttgtcaatcaaagtgccacctgtgtctccttggcccatgaaactcctccaacagcattaattttggatgttctaagtggcaggcctttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtccgtgttctagtggtgcctgcagaaaactatgactaccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggggccaccggccctcactgcagccctgagggtgggcagtgcccatgccagcccaacgtcatcgggcggcagtgcacccgctgtgcaacaggccactacggattcccacgctgcaagccgtgcagctgtggtcggcgcctttgtgaagagatgacggggcagtgccgctgccctccccgcacggtcaggccccagtgtgaggtgtgtgagacacactcattcagcttccaccccatggccggctgcgaaggctgcaactgttccaggaggggcaccatcgaggctgccatgccggagtgtgaccgggacagcgggcagtgcagatgcaagcccagaatcacagggcggcagtgtgaccgatgtgcttccgggttttaccgctttcctgagtgtgttccctgcaattgcaacagagatgggactgagccaggagtgtgtgacccagggaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgcccgcaaccatccacagcgcgtcctgggtcgcacccacctcctacctgggggacaaggtttcttcatatggtggttacctcacttaccaagccaagtcctttggcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggaaggctgaggcaagagggttgcttgaggccaagagttcgagaccagtcttggaaacacagtgaaaccatgtctctacgaaaactaaaataaaataaaa

SEQ ID NO: 2432 - DNA, 8506 bp, synthetic construct
  misc_feature 1..8506: note = Synthetic polypeptide
  source 1..8506: mol_type = other DNA
atggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactccaatttggggtattgccaatgcaagcttcatgttgaaggtcctacttgtagccgctgcaaactgttatattggaatctggacaaagaaaaccccagtggatgttcagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtaccctggcttgtgaggccagacacttcctgcttgatggggagccaagacccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctgcatcaagtttgtatcatacctattgaagaattctcagctgagtatgtgagaccacaagtccactgcattgccagttatgggcgatttgtcaatcaaagtgccacctgtgtctccttggcccatgaaactcctccaacagcattaattttggatgttctaagtggcaggcctttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtccgtgttctagtggtgcctgcagaaaactatgactaccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggggccaccggccctcactgcagccctgagggtgggcagtgcccatgccagcccaacgtcatcgggcggcagtgcacccgctgtgcaacaggccactacggattcccacgctgcaagccgtgcagctgtggtcggcgcctttgtgaagagatgacggggcagtgccgctgccctccccgcacggtcaggccccagtgtgaggtgtgtgagacacactcattcagcttccaccccatggccggctgcgaaggctgcaactgttccaggaggggcaccatcgaggctgccatgccggagtgtgaccgggacagcgggcagtgcagatgcaagcccagaatcacagggcggcagtgtgaccgatgtgcttccgggttttaccgctttcctgagtgtgttccctgcaattgcaacagagatgggactgagccaggagtgtgtgacccagggaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgcccgcaaccatccacagcgcgtcctgggtcgcacccacctcctacctgggggacaaggtttcttcatatggtggttacctcacttaccaagccaagtcctttggcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacatgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggaaggctgaggcaagagggttgcttgaggccaagagttcgagaccagtcttggaaacacagtgaaaccatgtctctacgaaaactaaaataaaataaaa

SEQ ID NO: 2433 - DNA, 3847 bp, synthetic construct
  misc_feature 1..3847: note = Synthetic polypeptide
  source 1..3847: mol_type = other DNA
atgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggaaggctgaggcaagagggttgcttgaggccaagagttcgagaccagtcttggaaacacagtgaaaccatgtctctacgaaaactaaaataaaataaaa

SEQ ID NO: 2434 - DNA, 3679 bp, synthetic construct
  misc_feature 1..3679: note = Synthetic polypeptide
  source 1..3679: mol_type = other DNA
atgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacatgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggaaggctgaggcaagagggttgcttgaggccaagagttcgagaccagtcttggaaacacagtgaaaccatgtctctacgaaaactaaaataaaataaaa

SEQ ID NO: 2435 - DNA, 3452 bp, synthetic construct
  misc_feature 1..3452: note = Synthetic polypeptide
  source 1..3452: mol_type = other DNA
ctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggaaggctgaggcaagagggttgcttgaggccaagagttcgagaccagtcttggaaacacagtgaaaccatgtctctacgaaaactaaaataaaataaaa

SEQ ID NO: 2436 - DNA, 381 bp, synthetic construct
  misc_feature 1..381: note = Synthetic polypeptide
  source 1..381: mol_type = other DNA
agcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggaaggctgaggcaagagggttgcttgaggccaagagttcgagaccagtcttggaaacacagtgaaaccatgtctctacgaaaactaaaataaaataaaa

SEQ ID NO: 2437 - DNA, 890 bp, synthetic construct; identical to SEQ ID NO: 319
  misc_feature 1..890: note = Synthetic polypeptide
  source 1..890: mol_type = other DNA

SEQ ID NO: 2438 - DNA, 947 bp, synthetic construct; identical to SEQ ID NO: 320
  misc_feature 1..947: note = Synthetic polypeptide
  source 1..947: mol_type = other DNA

SEQ ID NO: 2439 - DNA, 1398 bp, synthetic construct; identical to SEQ ID NO: 948
  misc_feature 1..1398: note = Synthetic polypeptide
  source 1..1398: mol_type = other DNA

SEQ ID NO: 2440 - DNA, 1302 bp, synthetic construct; identical to SEQ ID NO: 949
  misc_feature 1..1302: note = Synthetic polypeptide
  source 1..1302: mol_type = other DNA

SEQ ID NO: 2441 - DNA, 316 bp, synthetic construct; identical to SEQ ID NO: 1815
  misc_feature 1..316: note = Synthetic polypeptide
  source 1..316: mol_type = other DNA

SEQ ID NO: 2442 - DNA, 1515 bp, synthetic construct; identical to SEQ ID NO: 1980
  misc_feature 1..1515: note = Synthetic polypeptide
  source 1..1515: mol_type = other DNA

SEQ ID NO: 2443 - DNA, 143 bp, synthetic construct; identical to SEQ ID NO: 1010
  misc_feature 1..143: note = Synthetic polypeptide
  source 1..143: mol_type = other DNA

SEQ ID NO: 2444 - DNA, 314 bp, synthetic construct; identical to SEQ ID NO: 1011
  misc_feature 1..314: note = Synthetic polypeptide
  source 1..314: mol_type = other DNA

SEQ ID NO: 2445 - DNA, 3220 bp, synthetic construct; identical to SEQ ID NO: 248
  misc_feature 1..3220: note = Synthetic polypeptide
  source 1..3220: mol_type = other DNA

SEQ ID NO: 2446 - DNA, 965 bp, synthetic construct; identical to SEQ ID NO: 1615
  misc_feature 1..965: note = Synthetic polypeptide
  source 1..965: mol_type = other DNA

SEQ ID NO: 2447 - DNA, 2572 bp, synthetic construct; identical to SEQ ID NO: 1541
  misc_feature 1..2572: note = Synthetic polypeptide
  source 1..2572: mol_type = other DNA

SEQ ID NO: 2448 - DNA, 2407 bp, synthetic construct; identical to SEQ ID NO: 1542
  misc_feature 1..2407: note = Synthetic polypeptide
  source 1..2407: mol_type = other DNA

SEQ ID NO: 2449 - DNA, 651 bp, synthetic construct; identical to SEQ ID NO: 1543
  misc_feature 1..651: note = Synthetic polypeptide
  source 1..651: mol_type = other DNA

SEQ ID NO: 2450 - DNA, 391 bp, synthetic construct; identical to SEQ ID NO: 1544
  misc_feature 1..391: note = Synthetic polypeptide
  source 1..391: mol_type = other DNA

SEQ ID NO: 2451 - DNA, 2713 bp, synthetic construct; identical to SEQ ID NO: 1273
  misc_feature 1..2713: note = Synthetic polypeptide
  source 1..2713: mol_type = other DNA

SEQ ID NO: 2452 - DNA, 228 bp, synthetic construct; identical to SEQ ID NO: 1274
  misc_feature 1..228: note = Synthetic polypeptide
  source 1..228: mol_type = other DNA

SEQ ID NO: 2453 - DNA, 303 bp, synthetic construct; identical to SEQ ID NO: 148
  misc_feature 1..303: note = Synthetic polypeptide
  source 1..303: mol_type = other DNA

SEQ ID NO: 2454 - DNA, 301 bp, synthetic construct; identical to SEQ ID NO: 147
  misc_feature 1..301: note = Synthetic polypeptide
  source 1..301: mol_type = other DNA

SEQ ID NO: 2455 - DNA, 103 bp, synthetic construct; identical to SEQ ID NO: 173
  misc_feature 1..103: note = Synthetic polypeptide
  source 1..103: mol_type = other DNA

SEQ ID NO: 2456 - DNA, 952 bp, synthetic construct; identical to SEQ ID NO: 1617
  misc_feature 1..952: note = Synthetic polypeptide
  source 1..952: mol_type = other DNA

SEQ ID NO: 2457 - DNA, 1394 bp, synthetic construct; identical to SEQ ID NO: 1118
  misc_feature 1..1394: note = Synthetic polypeptide
  source 1..1394: mol_type = other DNA

SEQ ID NO: 2458 - DNA, 1625 bp, synthetic construct; identical to SEQ ID NO: 1119
  misc_feature 1..1625: note = Synthetic polypeptide
  source 1..1625: mol_type = other DNA

SEQ ID NO: 2459 - DNA, 1505 bp, synthetic construct; identical to SEQ ID NO: 1120
  misc_feature 1..1505: note = Synthetic polypeptide
  source 1..1505: mol_type = other DNA

SEQ ID NO: 2460 - DNA, 1562 bp, synthetic construct; identical to SEQ ID NO: 1121
  misc_feature 1..1562: note = Synthetic polypeptide
  source 1..1562: mol_type = other DNA

SEQ ID NO: 2461 - DNA, 1601 bp, synthetic construct; identical to SEQ ID NO: 1122
  misc_feature 1..1601: note = Synthetic polypeptide
  source 1..1601: mol_type = other DNA

SEQ ID NO: 2462 - DNA, 1631 bp, synthetic construct; identical to SEQ ID NO: 1123
  misc_feature 1..1631: note = Synthetic polypeptide
  source 1..1631: mol_type = other DNA

SEQ ID NO: 2463 - DNA, 1470 bp, synthetic construct; identical to SEQ ID NO: 1592
  misc_feature 1..1470: note = Synthetic polypeptide
  source 1..1470: mol_type = other DNA

SEQ ID NO: 2464 - DNA, 202 bp, synthetic construct; identical to SEQ ID NO: 1593
  misc_feature 1..202: note = Synthetic polypeptide
  source 1..202: mol_type = other DNA

SEQ ID NO: 2465 - DNA, 980 bp, synthetic construct; identical to SEQ ID NO: 139
  misc_feature 1..980: note = Synthetic polypeptide
  source 1..980: mol_type = other DNA

SEQ ID NO: 2466 - DNA, 1256 bp, synthetic construct; identical to SEQ ID NO: 140
  misc_feature 1..1256: note = Synthetic polypeptide
  source 1..1256: mol_type = other DNA

SEQ ID NO: 2467 - DNA, 1277 bp, synthetic construct; identical to SEQ ID NO: 142
  misc_feature 1..1277: note = Synthetic polypeptide
  source 1..1277: mol_type = other DNA

SEQ ID NO: 2468 - DNA, 1052 bp, synthetic construct; identical to SEQ ID NO: 247
  misc_feature 1..1052: note = Synthetic polypeptide
  source 1..1052: mol_type = other DNA

SEQ ID NO: 2469 - DNA, 327 bp, synthetic construct; identical to SEQ ID NO: 246
  misc_feature 1..327: note = Synthetic polypeptide
  source 1..327: mol_type = other DNA

SEQ ID NO: 2470 - DNA, 639 bp, synthetic construct; identical to SEQ ID NO: 1176
  misc_feature 1..639: note = Synthetic polypeptide
  source 1..639: mol_type = other DNA

SEQ ID NO: 2471 - DNA, 666 bp, synthetic construct
  misc_feature 1..666: note = Synthetic polypeptide
  source 1..666: mol_type = other DNA
atgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggacttcagtgccatctccaagatacttcaaatatgtatgtgcaggtactccaaagtccaaaacacttcggtcccaagcattttgaataagggatactcaacatg

SEQ ID NO: 2472 - DNA, 649 bp, synthetic construct; identical to SEQ ID NO: 2075
  misc_feature 1..649: note = Synthetic polypeptide
  source 1..649: mol_type = other DNA

SEQ ID NO: 2473 - DNA, 500 bp, synthetic construct; identical to SEQ ID NO: 204
  misc_feature 1..500: note = Synthetic polypeptide
  source 1..500: mol_type = other DNA

SEQ ID NO: 2474 - DNA, 656 bp, synthetic construct; identical to SEQ ID NO: 205
  misc_feature 1..656: note = Synthetic polypeptide
  source 1..656: mol_type = other DNA

SEQ ID NO: 2475 - DNA, 524 bp, synthetic construct; identical to SEQ ID NO: 207
  misc_feature 1..524: note = Synthetic polypeptide
  source 1..524: mol_type = other DNA

SEQ ID NO: 2476 - DNA, 732 bp, synthetic construct
  misc_feature 1..732: note = Synthetic polypeptide
  source 1..732: mol_type = other DNA
atgcctttgttcaccgccaaccccttcgagcaagacgtggaaaaagccacgaatgagtacaacactacagaagattggagtcttattatggacatatgtgacaaagttggaagtactcctaatggagcgaaagattgcctaaaagccataatgaaaagggtaaatcataaggttccacatgttgctctgcaagcactaactcttcttggggcttgtgtggcaaactgtggaaagatatttcatttagaagtatgttcccgtgattttgcaacagaagtacgtgctgtgattaaaaataaggcacatcctaaagtatgtgaaaaactgaaatctttaatggtggagtggtcagaagaatttcagaaggaccctcagtttagtctgatatctgcaactattaaatctatgaaagaagaaggaattacttttcctccagcaggttctcagggctgggcgcggtggctcacgcctgtaatcccagcactttgggaggccgaagtgggcagatcatgaggtcaagagatcgagaccagcctgaccaacaaggtgaaaccccatctctactaaaagtacaaaaattagctgggcgtggtggcgggcgcctgtagtcccaactactcgggaggctgaggcaggagaatcgcttgaacccaggaggcggaggttgcagtgagccaagatggcaccactgtgctccagcctggcgatggagtgagactccatctcaaaaaa

SEQ ID NO: 2477 - DNA, 721 bp, synthetic construct; identical to SEQ ID NO: 414
  misc_feature 1..721: note = Synthetic polypeptide
  source 1..721: mol_type = other DNA

SEQ ID NO: 2478 - DNA, 4591 bp, synthetic construct
  misc_feature 1..4591: note = Synthetic polypeptide
  source 1..4591: mol_type = other DNA
atgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagccgcctgccttggcctcccaaagtgccgagattgcagcctctgcccggccgccaccccgtctgggaagtgaggagcatctctgcctggctgccaatcgtctgggatgtgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccgcccatcgtctgagatgtggggagcgcctctgccctgctgcctcgtccaggatgtgaggagcgtctctgcccggccgccccgtctgagaagtgaggagaccctctgcctggcaaccgccccgtctgagaagtgaggagcccctccgcccggcagccgccccgtctgagaagtgaggagcccctccgcctggccagccgccccgtccgggaggtgaggggcgcctctgcccggctgcccctactgggaagtgaggagcctctctgcctggccagccgccccgtccgggagggaggtgggggggtcagccccccgcccggccagccgccctgtccgggaggtgaggggcgcctctgcccggccgcccctactgggaagtgaggagcacctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaaaaaagaa

SEQ ID NO: 2479 - DNA, 4261 bp, synthetic construct
  misc_feature 1..4261: note = Synthetic polypeptide
  source 1..4261: mol_type = other DNA
atggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagccgcctgccttggcctcccaaagtgccgagattgcagcctctgcccggccgccaccccgtctgggaagtgaggagcatctctgcctggctgccaatcgtctgggatgtgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccgcccatcgtctgagatgtggggagcgcctctgccctgctgcctcgtccaggatgtgaggagcgtctctgcccggccgccccgtctgagaagtgaggagaccctctgcctggcaaccgccccgtctgagaagtgaggagcccctccgcccggcagccgccccgtctgagaagtgaggagcccctccgcctggccagccgccccgtccgggaggtgaggggcgcctctgcccggctgcccctactgggaagtgaggagcctctctgcctggccagccgccccgtccgggagggaggtgggggggtcagccccccgcccggccagccgccctgtccgggaggtgaggggcgcctctgcccggccgcccctactgggaagtgaggagcacctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaaaaaagaa

SEQ ID NO: 2480 - DNA, 1640 bp, synthetic construct
  misc_feature 1..1640: note = Synthetic polypeptide
  source 1..1640: mol_type = other DNA
atggcggtcaaggtgcagacaactaagcgaggggatcctcatgagttaagaaacatatttctacagtatgccagtactgaggttgatggagagcgttatatgaccccagaagactttgttcagcgctatcttggactgtataatgatccaaatagtaacccaaagatcgtgcagctcttggcaggagtagctgatcaaaccaaggatggccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggtgaggagcgtctctgcctggccgccccatcagagaagtgaggagaccctccgcctggcaactgccccgtctgagaagtgaggagcccctccgcccggcagccgccccgtctgggaagtgaggagcgtctccgcccggcagccaccccgtccgggagggaggtgggggtcagcccccgccaggccagccgccccgtccgggagggaggtggggggggtcagccccccacccggccagccgccccatccgggaggtgaggggcgcctctgcccggctgcccctactgggaagtgaggagcccctctgcacagccagccgccccgttcgggagggaggtgggggggtcagccccccgcccggccagccgccccgtccgggagggaggtgggggggtcagccccccgcccggccagccgcccggttcgggaggtgaggggcgcctctgcccggccgcccctactgggaagtgaggagcccctctgcccggccagccaccccgtccgggagggaggtggggggtcagccccctgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaa

SEQ ID NO: 2481 - DNA, 1435 bp, synthetic construct
  misc_feature 1..1435: note = Synthetic polypeptide
  source 1..1435: mol_type = other DNA
atggccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggtgaggagcgtctctgcctggccgccccatcagagaagtgaggagaccctccgcctggcaactgccccgtctgagaagtgaggagcccctccgcccggcagccgccccgtctgggaagtgaggagcgtctccgcccggcagccaccccgtccgggagggaggtgggggtcagcccccgccaggccagccgccccgtccgggagggaggtggggggggtcagccccccacccggccagccgccccatccgggaggtgaggggcgcctctgcccggctgcccctactgggaagtgaggagcccctctgcacagccagccgccccgttcgggagggaggtgggggggtcagccccccgcccggccagccgccccgtccgggagggaggtgggggggtcagccccccgcccggccagccgcccggttcgggaggtgaggggcgcctctgcccggccgcccctactgggaagtgaggagcccctctgcccggccagccaccccgtccgggagggaggtggggggtcagccccctgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaa

SEQ ID NO: 2482 - DNA, 1628 bp, synthetic construct
  misc_feature 1..1628: note = Synthetic polypeptide
  source 1..1628: mol_type = other DNA
gtgcagacaactaagcgaggggatcctcatgagttaagaaacatatttctacagtatgccagtactgaggttgatggagagcgttatatgaccccagaagactttgttcagcgctatcttggactgtataatgatccaaatagtaacccaaagatcgtgcagctcttggcaggagtagctgatcaaaccaaggatggccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggtgaggagcgtctctgcctggccgccccatcagagaagtgaggagaccctccgcctggcaactgccccgtctgagaagtgaggagcccctccgcccggcagccgccccgtctgggaagtgaggagcgtctccgcccggcagccaccccgtccgggagggaggtgggggtcagcccccgccaggccagccgccccgtccgggagggaggtggggggggtcagccccccacccggccagccgccccatccgggaggtgaggggcgcctctgcccggctgcccctactgggaagtgaggagcccctctgcacagccagccgccccgttcgggagggaggtgggggggtcagccccccgcccggccagccgccccgtccgggagggaggtgggggggtcagccccccgcccggccagccgcccggttcgggaggtgaggggcgcctctgcccggccgcccctactgggaagtgaggagcccctctgcccggccagccaccccgtccgggagggaggtggggggtcagccccctgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaa

SEQ ID NO: 2483 - DNA, 47 bp, synthetic construct; identical to SEQ ID NO: 2074
  misc_feature 1..47: note = Synthetic polypeptide
  source 1..47: mol_type = other DNA

SEQ ID NO: 2484 - DNA, 572 bp, synthetic construct; identical to SEQ ID NO: 159
  misc_feature 1..572: note = Synthetic polypeptide
  source 1..572: mol_type = other DNA

SEQ ID NO: 2485 - DNA, 3881 bp, synthetic construct; identical to SEQ ID NO: 1162
  misc_feature 1..3881: note = Synthetic polypeptide
  source 1..3881: mol_type = other DNA

SEQ ID NO: 2486 - DNA, 3722 bp, synthetic construct; identical to SEQ ID NO: 1163
  misc_feature 1..3722: note = Synthetic polypeptide
  source 1..3722: mol_type = other DNA

SEQ ID NO: 2487 - DNA, 1736 bp, synthetic construct; identical to SEQ ID NO: 156
  misc_feature 1..1736: note = Synthetic polypeptide
  source 1..1736: mol_type = other DNA

SEQ ID NO: 2488 - DNA, 1724 bp, synthetic construct; identical to SEQ ID NO: 157
  misc_feature 1..1724: note = Synthetic polypeptide
  source 1..1724: mol_type = other DNA

SEQ ID NO: 2489 - DNA, 432 bp, synthetic construct
  misc_feature 1..432: note = Synthetic polypeptide
  source 1..432: mol_type = other DNA
atgcagtccctgatgcaggctcccctcctgatcgccctgggcttgcttctcgcggcccctgcgcaagcccacctgaaaaagcccatggccttctcccagtgcctggagcagccaagcttctttgtgcctcggggcctttgcctgagttccctcggcctgcacttacatgtctgactccgcatcctgcaagagcccggcttaagtatcacttccccaccaccctatgtaagtgagtcctttgttgctgtcagcattaccttctgctcttttcctttgtggcactcacaaatcatagtgggtgatatttatttgcattagacggtaagctcctcaaggcagggcaggagccaggtctgattgtttaccactcttgccacagcacttagcccagggcctatcatcattgctccataaatatttgtggaatgaatg

SEQ ID NO: 2490 - DNA, 609 bp, synthetic construct; identical to SEQ ID NO: 249
  misc_feature 1..609: note = Synthetic polypeptide
  source 1..609: mol_type = other DNA

SEQ ID NO: 2491 - DNA, 738 bp, synthetic construct; identical to SEQ ID NO: 250
  misc_feature 1..738: note = Synthetic polypeptide
  source 1..738: mol_type = other DNA

SEQ ID NO: 2492 - DNA, 537 bp, synthetic construct; identical to SEQ ID NO: 251
  misc_feature 1..537: note = Synthetic polypeptide
  source 1..537: mol_type = other DNA

SEQ ID NO: 2493 - DNA, 684 bp, synthetic construct; identical to SEQ ID NO: 253
  misc_feature 1..684: note = Synthetic polypeptide
  source 1..684: mol_type = other DNA

SEQ ID NO: 2494 - DNA, 285 bp, synthetic construct; identical to SEQ ID NO: 255
  misc_feature 1..285: note = Synthetic polypeptide
  source 1..285: mol_type = other DNA

SEQ ID NO: 2495 - DNA, 552 bp, synthetic construct; identical to SEQ ID NO: 254
  misc_feature 1..552: note = Synthetic polypeptide
  source 1..552: mol_type = other DNA

SEQ ID NO: 2496 - DNA, 750 bp, synthetic construct; identical to SEQ ID NO: 1060
  misc_feature 1..750: note = Synthetic polypeptide
  source 1..750: mol_type = other DNA

SEQ ID NO: 2497 - DNA, 296 bp, synthetic construct; identical to SEQ ID NO: 1061
  misc_feature 1..296: note = Synthetic polypeptide
  source 1..296: mol_type = other DNA

SEQ ID NO: 2498 - DNA, 1472 bp, synthetic construct
  misc_feature 1..1472: note = Synthetic polypeptide
  source 1..1472: mol_type = other DNA
atggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatgacaaaacaagatcctgtctcaaaaagaaaaaaaaaaaaaa

SEQ ID NO: 2499 - DNA, 2151 bp, synthetic construct; identical to SEQ ID NO: 127
  misc_feature 1..2151: note = Synthetic polypeptide
  source 1..2151: mol_type = other DNA

SEQ ID NO: 2500 - DNA, 1833 bp, synthetic construct; identical to SEQ ID NO: 126
  misc_feature 1..1833: note = Synthetic polypeptide
  source 1..1833: mol_type = other DNA

SEQ ID NO: 2501 - DNA, 1834 bp, synthetic construct; identical to SEQ ID NO: 133
  misc_feature 1..1834: note = Synthetic polypeptide
  source 1..1834: mol_type = other DNA

SEQ ID NO: 2502 - DNA, 1765 bp, synthetic construct; identical to SEQ ID NO: 135
  misc_feature 1..1765: note = Synthetic polypeptide
  source 1..1765: mol_type = other DNA

SEQ ID NO: 2503 - DNA, 2154 bp, synthetic construct; identical to SEQ ID NO: 1502
  misc_feature 1..2154: note = Synthetic polypeptide
  source 1..2154: mol_type = other DNA

SEQ ID NO: 2504 - DNA, 2025 bp, synthetic construct; identical to SEQ ID NO: 1503
  misc_feature 1..2025: note = Synthetic polypeptide
  source 1..2025: mol_type = other DNA

SEQ ID NO: 2505 - DNA, 102 bp, synthetic construct; identical to SEQ ID NO: 258
  misc_feature 1..102: note = Synthetic polypeptide
  source 1..102: mol_type = other DNA

SEQ ID NO: 2506 - DNA, 82 bp, synthetic construct; identical to SEQ ID NO: 257
  misc_feature 1..82: note = Synthetic polypeptide
  source 1..82: mol_type = other DNA

SEQ ID NO: 2507 - DNA, 531 bp, synthetic construct
  misc_feature 1..531: note = Synthetic polypeptide
  source 1..531: mol_type = other DNA
atgtattttctgagcggctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaaagcttctgcgcagcaaaagaaactaccatcagagtgaagaggcaacctacagaatgggagaacatttttgcaatctactcatctgacaaagggctaatatccagcatctacaaaggactcaaacaaatttacaagaaaaaaacaaccccatcaaaaagtgggcaaaggatatgaacagacacttctcaaaagaagacat

SEQ ID NO: 2508 - DNA, 294 bp, synthetic construct
  misc_feature 1..294: note = Synthetic polypeptide
  source 1..294: mol_type = other DNA
atgatagctgtatcaacggcaaatggatacatcttgttttttcatattacatctacaagaggggacaagtacctttatgaaccagtgtatcccaaagcttctgcgcagcaaaagaaactaccatcagagtgaagaggcaacctacagaatgggagaacatttttgcaatctactcatctgacaaagggctaatatccagcatctacaaaggactcaaacaaatttacaagaaaaaaacaaccccatcaaaaagtgggcaaaggatatgaacagacacttctcaaaagaagacat

SEQ ID NO: 2509 - DNA, 316 bp, synthetic construct
  misc_feature 1..316: note = Synthetic polypeptide
  source 1..316: mol_type = other DNA
tgaatggaggccagatagtaccatgatagctgtatcaacggcaaatggatacatcttgttttttcatattacatctacaagaggggacaagtacctttatgaaccagtgtatcccaaagcttctgcgcagcaaaagaaactaccatcagagtgaagaggcaacctacagaatgggagaacatttttgcaatctactcatctgacaaagggctaatatccagcatctacaaaggactcaaacaaatttacaagaaaaaaacaaccccatcaaaaagtgggcaaaggatatgaacagacacttctcaaaagaagacat

SEQ ID NO: 2510 - DNA, 1091 bp, synthetic construct; identical to SEQ ID NO: 2032
  misc_feature 1..1091: note = Synthetic polypeptide
  source 1..1091: mol_type = other DNA

SEQ ID NO: 2511 - DNA, 657 bp, synthetic construct
  misc_feature 1..657: note = Synthetic polypeptide
  source 1..657: mol_type = other DNA
atgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2512 - DNA, 630 bp, synthetic construct
  misc_feature 1..630: note = Synthetic polypeptide
  source 1..630: mol_type = other DNA
atggctttccagctgagcaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2513 - DNA, 693 bp, synthetic construct
  misc_feature 1..693: note = Synthetic polypeptide
  source 1..693: mol_type = other DNA
atgctcctgcttcggagaagcttgtcactaaacgtcctcagaaaggaagtcgacagggcctgttttggggagaaggccaaacagatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2514 - DNA, 783 bp, synthetic construct
  misc_feature 1..783: note = Synthetic polypeptide
  source 1..783: mol_type = other DNA
atgaagctgcttgccagggctctccggctctgtgagtttgggaggcaggcatcttccaggaggctggtggctggccagggatgtgtggggccccggcgagggtgctgcgctcccgtccaggtggttgggcccagggctgatctcccaccctgtggagcctgcattactggaaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2515 - DNA, 438 bp, synthetic construct
  misc_feature 1..438: note = Synthetic polypeptide
  source 1..438: mol_type = other DNA
atgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2516 - DNA, 753 bp, synthetic construct
  misc_feature 1..753: note = Synthetic polypeptide
  source 1..753: mol_type = other DNA
atggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2517 - DNA, 606 bp, synthetic construct
  misc_feature 1..606: note = Synthetic polypeptide
  source 1..606: mol_type = other DNA
atgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2518 - DNA, 1629 bp, synthetic construct
  misc_feature 1..1629: note = Synthetic polypeptide
  source 1..1629: mol_type = other DNA
atgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggagccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgaggcctccttgcctatgaaattgaattaatggcacctcctccccttcgggcttgctgcgagagaggaagggcatgagtgggtttacaagcgcctggagcag

SEQ ID NO: 2519 - DNA, 991 bp, synthetic construct
  misc_feature 1..991: note = Synthetic polypeptide
  source 1..991: mol_type = other DNA
atgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagagaacctctccctctttgttatttaggttga

SEQ ID NO: 2520 - DNA, 1132 bp, synthetic construct
  misc_feature 1..1132: note = Synthetic polypeptide
  source 1..1132: mol_type = other DNA
atgaaaacgccgccgggcgcttctagtcggacaaaatgcagccgagaactccgctcgttctgtgcgttctcctgtcccagggccaaacaacccacctgcactgcatggttcccccagcaagaacatcccagtgagaatggcccacagatgcctgggcgtgacccacctgcagcttcaaccatgcaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagagaacctctccctctttgttatttaggttga

SEQ ID NO: 2521 - DNA, 874 bp, synthetic construct
  misc_feature 1..874: note = Synthetic polypeptide
  source 1..874: mol_type = other DNA
atgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagagaacctctccctctttgttatttaggttga

SEQ ID NO: 2522 - DNA, 1094 bp, synthetic construct; identical to SEQ ID NO: 153
  misc_feature 1..1094: note = Synthetic polypeptide
  source 1..1094: mol_type = other DNA

SEQ ID NO: 2523 - DNA, 5505 bp, synthetic construct; identical to SEQ ID NO: 1545
  misc_feature 1..5505: note = Synthetic polypeptide
  source 1..5505: mol_type = other DNA

SEQ ID NO: 2524 - DNA, 5418 bp, synthetic construct; identical to SEQ ID NO: 1546
  misc_feature 1..5418: note = Synthetic polypeptide
  source 1..5418: mol_type = other DNA

SEQ ID NO: 2525 - DNA, 312 bp, synthetic construct
  misc_feature 1..312: note = Synthetic polypeptide
  source 1..312: mol_type = other DNA
atggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcatggtggcacgttcctgcagtcccagcagctactccggaggctgaggcaggaggatcgcttgagcctaggagttgagccatgatcacaccactgcactccagtctagacgacacagcgagacactgtattaaaaaaaagaaaagaaagaaaagtaaaaaa

SEQ ID NO: 2526 - DNA, 1139 bp, synthetic construct
  misc_feature 1..1139: note = Synthetic polypeptide
  source 1..1139: mol_type = other DNA
atgaagaccaaatatatattttgcaatatcacagaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaaggggttgatttagtaagaagaaccttatcagatgccaccaccttgatattggacttccagtctccagaactattatacgataaataaagttctttttttaataaattacctagtttctgatattctgttatagcaacacaaaacagactaagac

SEQ ID NO: 2527 - DNA, 1877 bp, synthetic construct
  misc_feature 1..1877: note = Synthetic polypeptide
  source 1..1877: mol_type = other DNA
atgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaaggggttgatttagtaagaagaaccttatcagatgccaccaccttgatattggacttccagtctccagaactattatacgataaataaagttctttttttaataaattacctagtttctgatattctgttatagcaacacaaaacagactaagac

SEQ ID NO: 2528 - DNA, 1895 bp, synthetic construct
  misc_feature 1..1895: note = Synthetic polypeptide
  source 1..1895: mol_type = other DNA
atgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaatgtgagtgctgctaacttgtccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaaggggttgatttagtaagaagaaccttatcagatgccaccaccttgatattggacttccagtctccagaactattatacgataaataaagttctttttttaataaattacctagtttctgatattctgttatagcaacacaaaacagactaagac

SEQ ID NO: 2529 - DNA, 177 bp, synthetic construct; identical to SEQ ID NO: 1519
  misc_feature 1..177: note = Synthetic polypeptide
  source 1..177: mol_type = other DNA

SEQ ID NO: 2530 - DNA, 55 bp, synthetic construct; identical to SEQ ID NO: 291
  misc_feature 1..55: note = Synthetic polypeptide
  source 1..55: mol_type = other DNA

SEQ ID NO: 2531 - DNA, 25 bp, synthetic construct
  misc_feature 1..25: note = Synthetic polypeptide
  source 1..25: mol_type = other DNA
atgagcgtcctttcgtttttttaaa

SEQ ID NO: 2532 - DNA, 1426 bp, synthetic construct; identical to SEQ ID NO: 1626
  misc_feature 1..1426: note = Synthetic polypeptide
  source 1..1426: mol_type = other DNA

SEQ ID NO: 2533 - DNA, 533 bp, synthetic construct; identical to SEQ ID NO: 1098
  misc_feature 1..533: note = Synthetic polypeptide
  source 1..533: mol_type = other DNA

SEQ ID NO: 2534 - DNA, 763 bp, synthetic construct; identical to SEQ ID NO: 261
  misc_feature 1..763: note = Synthetic polypeptide
  source 1..763: mol_type = other DNA

SEQ ID NO: 2535 - DNA, 646 bp, synthetic construct; identical to SEQ ID NO: 262
  misc_feature 1..646: note = Synthetic polypeptide
  source 1..646: mol_type = other DNA

SEQ ID NO: 2536 - DNA, 1284 bp, synthetic construct
  misc_feature 1..1284: note = Synthetic polypeptide
  source 1..1284: mol_type = other DNA
atgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtgactctgaggcttctttcagttataagatactatg

SEQ ID NO: 2537 - DNA, 1839 bp, synthetic construct; identical to SEQ ID NO: 1059
  misc_feature 1..1839: note = Synthetic polypeptide
  source 1..1839: mol_type = other DNA

SEQ ID NO: 2538 - DNA, 168 bp, synthetic construct
  misc_feature 1..168: note = Synthetic polypeptide
  source 1..168: mol_type = other DNA
atgtcggccggcggagcgtcagtcccgccgcccccgaaccccgccgtgtccttcccgccgccccgggtcaccctgcccgccggccccgacatcctgcggacctactcgggcgccttcgtctgcctggagattcacctggcatagtgcctgaaatgtagtaggtattta

SEQ ID NO: 2539 - DNA, 722 bp, synthetic construct; identical to SEQ ID NO: 1598
  misc_feature 1..722: note = Synthetic polypeptide
  source 1..722: mol_type = other DNA

SEQ ID NO: 2540 - DNA, 866 bp, synthetic construct; identical to SEQ ID NO: 1599
  misc_feature 1..866: note = Synthetic polypeptide
  source 1..866: mol_type = other DNA

SEQ ID NO: 2541 - DNA, 740 bp, synthetic construct; identical to SEQ ID NO: 1600
  misc_feature 1..740: note = Synthetic polypeptide
  source 1..740: mol_type = other DNA

SEQ ID NO: 2542 - DNA, 884 bp, synthetic construct
  misc_feature 1..884: note = Synthetic polypeptide
  source 1..884: mol_type = other DNA
atgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcactgggcgcaatggctcacgtctataatcccagcactctaggagtccgaggcagggggatcactagctgggaggctgaggcaggagaatcgcttgaacggagaggtggaggttgcagtaagccaagaacgcaccattgcactccagcctgggcgacaagagtgaaactccgtctcaaaaaaaaaaaaaaaaaaaaaaaagaaaaa

SEQ ID NO: 2543 - DNA, 623 bp, synthetic construct
  misc_feature 1..623: note = Synthetic polypeptide
  source 1..623: mol_type = other DNA
atgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactgggtactccaaagtccaaaacacttcggtcccaagcattttgaataagggatactcaacatg

SEQ ID NO: 2544 - DNA, 2361 bp, synthetic construct; identical to SEQ ID NO: 1330
  misc_feature 1..2361: note = Synthetic polypeptide
  source 1..2361: mol_type = other DNA

SEQ ID NO: 2545 - DNA, 2160 bp, synthetic construct; identical to SEQ ID NO: 1331
  misc_feature 1..2160: note = Synthetic polypeptide
  source 1..2160: mol_type = other DNA

SEQ ID NO: 2546 - DNA, 1908 bp, synthetic construct; identical to SEQ ID NO: 1332
  misc_feature 1..1908: note = Synthetic polypeptide
  source 1..1908: mol_type = other DNA

SEQ ID NO: 2547 - DNA, 2175 bp, synthetic construct; identical to SEQ ID NO: 1333
  misc_feature 1..2175: note = Synthetic polypeptide
  source 1..2175: mol_type = other DNA

SEQ ID NO: 2548 - DNA, 1606 bp, synthetic construct; identical to SEQ ID NO: 327
  misc_feature 1..1606: note = Synthetic polypeptide
  source 1..1606: mol_type = other DNA

SEQ ID NO: 2549 - DNA, 175 bp, synthetic construct; identical to SEQ ID NO: 329
  misc_feature 1..175: note = Synthetic polypeptide
  source 1..175: mol_type = other DNA

SEQ ID NO: 2550 - DNA, 1068 bp, synthetic construct; identical to SEQ ID NO: 1221
  misc_feature 1..1068: note = Synthetic polypeptide
  source 1..1068: mol_type = other DNA

SEQ ID NO: 2551 - DNA, 571 bp, synthetic construct
  misc_feature 1..571: note = Synthetic polypeptide
  source 1..571: mol_type = other DNA
atggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaggcagaaaagaaaatgctgacgtatgctgccttctctctctgcttcggctacctaaaagggaagggccctctatcctgtaatcacgtgacttgcttcaccttgtcaatcacttagaagattcaccctccttaccctgcccccttgtcttgtatgcgataaatatcagcgtgcccagccgttcggggccactaccggtctccacatcttggtggtagtggcccccaccctgggcccagctgttttctccttatctctttgtcttgtgtctttatttattacaatccctcgtctctgcacacggggagaacacccgctaagcccagtagggctggaccctaca

SEQ ID NO: 2552 - DNA, 1248 bp, synthetic construct
  misc_feature 1..1248: note = Synthetic polypeptide
  source 1..1248: mol_type = other DNA
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggtgggaactgaacaatgagaacacttggacacagggcggggaacatcacacaccagggcctgtcggggggtaggggtagggaggcgggatggcattaacagaaatacctattgtaaatgacgagttaatgggtgcagcacaccaacatggcacatgtatacatatgtaacaaacctgcactttgtgcacatgtaccctagaacttaaagtaaaatttaaaaaaaagagaa

SEQ ID NO: 2553 - DNA, 951 bp, synthetic construct
  misc_feature 1..951: note = Synthetic polypeptide
  source 1..951: mol_type = other DNA
atggaatgtctctactatttcctgggatttctgctcctggctgcaagattgccacttgatgccgccaaacaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggtgggaactgaacaatgagaacacttggacacagggcggggaacatcacacaccagggcctgtcggggggtaggggtagggaggcgggatggcattaacagaaatacctattgtaaatgacgagttaatgggtgcagcacaccaacatggcacatgtatacatatgtaacaaacctgcactttgtgcacatgtaccctagaacttaaagtaaaatttaaaaaaaagagaa

SEQ ID NO: 2554 - DNA, 1074 bp, synthetic construct
  misc_feature 1..1074: note = Synthetic polypeptide
  source 1..1074: mol_type = other DNA
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggtgggaactgaacaatgagaacacttggacacagggcggggaacatcacacaccagggcctgtcggggggtaggggtagggaggcgggatggcattaacagaaatacctattgtaaatgacgagttaatgggtgcagcacaccaacatggcacatgtatacatatgtaacaaacctgcactttgtgcacatgtaccctagaacttaaagtaaaatttaaaaaaaagagaa

SEQ ID NO: 2555 - DNA, 6132 bp, synthetic construct; identical to SEQ ID NO: 1117
  misc_feature 1..6132: note = Synthetic polypeptide
  source 1..6132: mol_type = other DNA

SEQ ID NO: 2556 - DNA, 677 bp, synthetic construct; identical to SEQ ID NO: 2175
  misc_feature 1..677: note = Synthetic polypeptide
  source 1..677: mol_type = other DNA

SEQ ID NO: 2557 - DNA, 77 bp, synthetic construct; identical to SEQ ID NO: 1778
  misc_feature 1..77: note = Synthetic polypeptide
  source 1..77: mol_type = other DNA

SEQ ID NO: 2558 - DNA, 299 bp, synthetic construct; identical to SEQ ID NO: 1033
  misc_feature 1..299: note = Synthetic polypeptide
  source 1..299: mol_type = other DNA

SEQ ID NO: 2559 - DNA, 191 bp, synthetic construct; identical to SEQ ID NO: 1034
  misc_feature 1..191: note = Synthetic polypeptide
  source 1..191: mol_type = other DNA

SEQ ID NO: 2560 - DNA, 1081 bp, synthetic construct
  misc_feature 1..1081: note = Synthetic polypeptide
  source 1..1081: mol_type = other DNA
atggcatttacagaaagagtcaacagcagtggcaacagcagcctgccttggcctcccaaagtgccgagattgcagcctctgcccggccgccaccccgtctgggaagtgaggagcgtctctgccaggccgcccatcgtctgggatgtgaggagcccttctgcctggctgcccagtctggaaagtgaggagcgtctctgcctggccgccatcccatctgggaagtgaggagcgtctctgcccggccgcccatcgtctgagatgtggggagcacctctgccctgccgccccgtccgggatgtgaggagcgtctctgcccggccgccccgtctgagaagtgaggagcccctccgcccggcagccgccccgtctgagaagtgaggagcccctccgcccagcagccaccccgtctgggaagtgaggagcgtctctgcccggcagccacctcgtctgggagggaggtgggggggtcaggcccccgcccggccagccgccctgtccgggaggtgaggggcacctctgcccggccgcccctactgggaagtgaggagcccctctgcctggccaccaccccgtctgggaggtgtacccaacagctcattgagaacgggccatgatgacaatggcggttttgtggaatagaaaggggggaaaggtggggaaaagattgagaaatcggatggttgctgtgtctgtgtagaaagaggtagacatgggagacttttcattttgttctgtactaagaaaaattcttctgccttgggatcctgttgatctgtgaccttacccccaaccctgtgctctctgaaacatgtgctgtatccactcagggttgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgtgagaaacacccaagaatgatcaat

SEQ ID NO: 2561 - DNA, 5107 bp, synthetic construct
  misc_feature 1..5107: note = Synthetic polypeptide
  source 1..5107: mol_type = other DNA
atgagggcactggtcagggcccattccatagcagggttttcaccagagtgccccgaggatcccgtgggacagaatgttgtgaagtctgggacccatgtgaaggaaggggccaaaaatgaacgagatccaagaatacaaaacatcccttcccctgcacccacccagctgtctggcccgattcctgcttttcagagtggggctccccatctgcagggtccctgcaagcctggtgggtttcgcttgcaaagggcctctcaggacactccttctgcaggtctcctgggggaaaaccagttaagacaggattccaggtcatgtctggtggcttcatgcctcacctcagagttagtgaagctcagtgcagaggaagtgcctgagcccgctgagtgcaagtcagagcaaagcccagaaagcagaacccaggaaccccaaggcacccaactcgcaccaagagctgctgatgagagagagacacagaagcacctctggggcatttctgtccaggcaggaaaccaaaccagtaattacacatcaaagtatgtgctcagcgaggaaagcaagtcacctaccagggccaagttcccacggcagcctagcagtgaggggacccaggtgtggagtggagacttgatgggctgcttggaagtgagtgacagttcagatgcccctgagaccacccagaaatcaagcgcaatagacacttcaaaggcagccgaagaagccatggttctagaccccaactacagggaacaggctttgcaaggtctttcagaattcaaggcagccacggtgtctcactgcggccccggggctgaggagggtgaacaggggcctgggggtgccgggggccggcagctggagcccaaagcaggcggcgaggcctcgaggggcaggggcgccctcatcattgtagctgtggagcagaaaggtcttcaggccagcaggagcaatgcggggcctgttccagaaacactgccccgtgactttcctaaggaaagaccagaatctcccttgagcactggcgagaccccctgtgagtctcccactagggggaaaacaccagccggtaatgagtgtgagttgccagcagcccccatacagggagctggcgatggggctcttcagcgggtggcccaggccgcagagcttgggagagtgctggtcccccaagctgcttcggaagagacgccgagcacagaggagcccccgggagagagactgcgtggggagagccggagctccgggtcaggggagcgtggcccggaggaggcccccgaaggcggtgctgcagcagcccggggccagcgcccccgcgtccccgccttggagccgccccagccgccacgcgggctccgcaagggcgcgcaggagcctgggaagcgcccgacgttttccaaggtgacctccttcaggaagggcaggcccttggccactgagagcccaggaggggtcccggccccgaccaccgagggtcgccgctggggctcttcaggccccgaggggctccccagggagaatccgcccgctgcggccggtcgggacgcaccgcctctgcaccacggggacgccagcgcctggcccgagtttgtcccgcaggctgcaggcgacaggactgcagggccggcaggagcggggcacacggggacctcaggggatcttggtagccgagggccttcctctgagagctgcaacgcaaagagactcaaaacaacggagaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcggtaggtacctaccttcaggtatctttccggaaaagtcctggctggcgtcccccggcagccctcgggcccagcaggctggaatcgcacacaccctgccttccagctctgcctgctgcctggcatatgaaaaccccgggacgccctgcagacccacgagccccaagcccctgagtcccaggcctagtgctcagcggatgggtctccactaccccgggaggggtagcgccatctccatggtttctcttggaagctacagctacgtggacagcagttcaggggaccctgaaagacccaagattcccaagggccagaccagtttcctgctttctctgcagacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccaatatcatactgaatgggcaaaaactggaagcattccctttgacaactggcacaagatagggatgccctatctcgccactcctattcaacatagtgttggaagttctggccagggcaatcaggcaagagaaagcaataaaggatattcagttaagaaaagagaaagtcaaattgtccctgtttgcaaatgacatgattgtatatttagaaaaccccatcgtttcagcccaaaatctccttaagctgataagcaacttcagcaaagtctcagggtacaaaatcaatgtgcaaaaatcacaagcattcctatacactaataacagacagccaaatcatgagtgaactcccattcacaattgttacaaagagaataaaatacctaggaatccaacttacaagggatgtgaaggacctcttcaaggagaactacaaaccactgctcaatgaaataaaagaggatacaaacaaatggaagaacattccatgctcatggataggaagaatcaatatcatgaaaatggccatactgcccaagataatttatagattcaatgccatccccatcaagctaccaatgactttcttcacagaattggaaaaaattactttaaagttcatatggaatcaaaaaaaaagcccgcattgccaagacaatcctaagcaaaaagaacaaaactggaggcatcatgctacctgacttcaaagtatactacaagtctacagtaaccaaaacagcatggtactggtaccaaaacagagatatagaccaatggaacagaacagaggcctcagaaataacaccacacatctacaaccatctgatctttgacaaacctgacaaaaacaagaaatggggaaaggattccctatttaataaatggtgttgggaaaactggctagccatatgtagaaagctgaaactggatcctttccttgcaccttatacaataattaattcaaggtggattaaaacttaaatgttagacctaaaatcgtaaaagccctagaagaaaacctaagcaataccattcaggacataggcatgggcgaggacttcatgactaaaacaccaaaagtaatggcaacaaaagccaaaatagacaaatgggatctaattaaactaaagagcttctgcacagcaaaagaaactaccattagagtgaacagacaacctacagaatgggagaaaatttttgcaatctacccatctgacaaagggctaacatccagaatctgcaaagaacttaaacaaatttacaagaaaaaaacaaccctgtcaaaaagtgggcaaaggatatgaacagacacttctcaaaagaagacatttatgcagccaacagacacatgaaaaaatgttcatcatcactggtcatcagagaaatgcaaatcaaaaccacaatgagataccatctcacaccagttagaatggcaatcattaaaaagtcaggaaacaacaggtgttggagagaatgtggagaaataggaatgctcttacactgttggtgggagtgtaaactagttcaaccattgtggaagacagtgtgacgattcctcaaggatctagaactagaaataccatttgacccagccatcccattactgggtatgtacccaaaggattataaatcatgctgctataaagacacgtgcacatgtatgtttattgcagcactgttcacaatagcaaagacttggaaccgacccaaatgtctgtcagtaatagactggattaagaaaatgtggcatatatacaccgtggaatactatggagccataaaaaaggatgagttcctgtcctttgcagggtcatggatgaagctggaaaccatcattctgagcaaactatcacaagaacagaaaaccaaacactgcatgttctcactcataggtgggaagtgaacaatgagaacacttggacacagggcggggaacatcacacagggaggcttgccatggggtggcagggggagggatagcattaggagaaatacctaatgtaaatgatgagttaatgggtgcagcacaccaatgtggcacatgtatacatatgtaacaaacctgcacgttgtgcacatgtaccttagaacttaaagtataattaaaaaaataa

SEQ ID NO: 2562 - DNA, 2539 bp, synthetic construct
  misc_feature 1..2539: note = Synthetic polypeptide
  source 1..2539: mol_type = other DNA
atgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccaatatcatactgaatgggcaaaaactggaagcattccctttgacaactggcacaagatagggatgccctatctcgccactcctattcaacatagtgttggaagttctggccagggcaatcaggcaagagaaagcaataaaggatattcagttaagaaaagagaaagtcaaattgtccctgtttgcaaatgacatgattgtatatttagaaaaccccatcgtttcagcccaaaatctccttaagctgataagcaacttcagcaaagtctcagggtacaaaatcaatgtgcaaaaatcacaagcattcctatacactaataacagacagccaaatcatgagtgaactcccattcacaattgttacaaagagaataaaatacctaggaatccaacttacaagggatgtgaaggacctcttcaaggagaactacaaaccactgctcaatgaaataaaagaggatacaaacaaatggaagaacattccatgctcatggataggaagaatcaatatcatgaaaatggccatactgcccaagataatttatagattcaatgccatccccatcaagctaccaatgactttcttcacagaattggaaaaaattactttaaagttcatatggaatcaaaaaaaaagcccgcattgccaagacaatcctaagcaaaaagaacaaaactggaggcatcatgctacctgacttcaaagtatactacaagtctacagtaaccaaaacagcatggtactggtaccaaaacagagatatagaccaatggaacagaacagaggcctcagaaataacaccacacatctacaaccatctgatctttgacaaacctgacaaaaacaagaaatggggaaaggattccctatttaataaatggtgttgggaaaactggctagccatatgtagaaagctgaaactggatcctttccttgcaccttatacaataattaattcaaggtggattaaaacttaaatgttagacctaaaatcgtaaaagccctagaagaaaacctaagcaataccattcaggacataggcatgggcgaggacttcatgactaaaacaccaaaagtaatggcaacaaaagccaaaatagacaaatgggatctaattaaactaaagagcttctgcacagcaaaagaaactaccattagagtgaacagacaacctacagaatgggagaaaatttttgcaatctacccatctgacaaagggctaacatccagaatctgcaaagaacttaaacaaatttacaagaaaaaaacaaccctgtcaaaaagtgggcaaaggatatgaacagacacttctcaaaagaagacatttatgcagccaacagacacatgaaaaaatgttcatcatcactggtcatcagagaaatgcaaatcaaaaccacaatgagataccatctcacaccagttagaatggcaatcattaaaaagtcaggaaacaacaggtgttggagagaatgtggagaaataggaatgctcttacactgttggtgggagtgtaaactagttcaaccattgtggaagacagtgtgacgattcctcaaggatctagaactagaaataccatttgacccagccatcccattactgggtatgtacccaaaggattataaatcatgctgctataaagacacgtgcacatgtatgtttattgcagcactgttcacaatagcaaagacttggaaccgacccaaatgtctgtcagtaatagactggattaagaaaatgtggcatatatacaccgtggaatactatggagccataaaaaaggatgagttcctgtcctttgcagggtcatggatgaagctggaaaccatcattctgagcaaactatcacaagaacagaaaaccaaacactgcatgttctcactcataggtgggaagtgaacaatgagaacacttggacacagggcggggaacatcacacagggaggcttgccatggggtggcagggggagggatagcattaggagaaatacctaatgtaaatgatgagttaatgggtgcagcacaccaatgtggcacatgtatacatatgtaacaaacctgcacgttgtgcacatgtaccttagaacttaaagtataattaaaaaaataa

SEQ ID NO: 2563 - DNA, 3079 bp, synthetic construct
  misc_feature 1..3079: note = Synthetic polypeptide
  source 1..3079: mol_type = other DNA
ccacttgcctccacacctttgtcctccagtttagtttctccagaacacaggaggaaaagtgaaccgaccatcaagtgcacagccacccaggaaggcggtaggtacctaccttcaggtatctttccggaaaagtcctggctggcgtcccccggcagccctcgggcccagcaggctggaatcgcacacaccctgccttccagctctgcctgctgcctggcatatgaaaaccccgggacgccctgcagacccacgagccccaagcccctgagtcccaggcctagtgctcagcggatgggtctccactaccccgggaggggtagcgccatctccatggtttctcttggaagctacagctacgtggacagcagttcaggggaccctgaaagacccaagattcccaagggccagaccagtttcctgctttctctgcagacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccaatatcatactgaatgggcaaaaactggaagcattccctttgacaactggcacaagatagggatgccctatctcgccactcctattcaacatagtgttggaagttctggccagggcaatcaggcaagagaaagcaataaaggatattcagttaagaaaagagaaagtcaaattgtccctgtttgcaaatgacatgattgtatatttagaaaaccccatcgtttcagcccaaaatctccttaagctgataagcaacttcagcaaagtctcagggtacaaaatcaatgtgcaaaaatcacaagcattcctatacactaataacagacagccaaatcatgagtgaactcccattcacaattgttacaaagagaataaaatacctaggaatccaacttacaagggatgtgaaggacctcttcaaggagaactacaaaccactgctcaatgaaataaaagaggatacaaacaaatggaagaacattccatgctcatggataggaagaatcaatatcatgaaaatggccatactgcccaagataatttatagattcaatgccatccccatcaagctaccaatgactttcttcacagaattggaaaaaattactttaaagttcatatggaatcaaaaaaaaagcccgcattgccaagacaatcctaagcaaaaagaacaaaactggaggcatcatgctacctgacttcaaagtatactacaagtctacagtaaccaaaacagcatggtactggtaccaaaacagagatatagaccaatggaacagaacagaggcctcagaaataacaccacacatctacaaccatctgatctttgacaaacctgacaaaaacaagaaatggggaaaggattccctatttaataaatggtgttgggaaaactggctagccatatgtagaaagctgaaactggatcctttccttgcaccttatacaataattaattcaaggtggattaaaacttaaatgttagacctaaaatcgtaaaagccctagaagaaaacctaagcaataccattcaggacataggcatgggcgaggacttcatgactaaaacaccaaaagtaatggcaacaaaagccaaaatagacaaatgggatctaattaaactaaagagcttctgcacagcaaaagaaactaccattagagtgaacagacaacctacagaatgggagaaaatttttgcaatctacccatctgacaaagggctaacatccagaatctgcaaagaacttaaacaaatttacaagaaaaaaacaaccctgtcaaaaagtgggcaaaggatatgaacagacacttctcaaaagaagacatttatgcagccaacagacacatgaaaaaatgttcatcatcactggtcatcagagaaatgcaaatcaaaaccacaatgagataccatctcacaccagttagaatggcaatcattaaaaagtcaggaaacaacaggtgttggagagaatgtggagaaataggaatgctcttacactgttggtgggagtgtaaactagttcaaccattgtggaagacagtgtgacgattcctcaaggatctagaactagaaataccatttgacccagccatcccattactgggtatgtacccaaaggattataaatcatgctgctataaagacacgtgcacatgtatgtttattgcagcactgttcacaatagcaaagacttggaaccgacccaaatgtctgtcagtaatagactggattaagaaaatgtggcatatatacaccgtggaatactatggagccataaaaaaggatgagttcctgtcctttgcagggtcatggatgaagctggaaaccatcattctgagcaaactatcacaagaacagaaaaccaaacactgcatgttctcactcataggtgggaagtgaacaatgagaacacttggacacagggcggggaacatcacacagggaggcttgccatggggtggcagggggagggatagcattaggagaaatacctaatgtaaatgatgagttaatgggtgcagcacaccaatgtggcacatgtatacatatgtaacaaacctgcacgttgtgcacatgtaccttagaacttaaagtataattaaaaaaataa

SEQ ID NO: 2564 - DNA, 4277 bp, synthetic construct; identical to SEQ ID NO: 2069
  misc_feature 1..4277: note = Synthetic polypeptide
  source 1..4277: mol_type = other DNA

SEQ ID NO: 2565 - DNA, 1156 bp, synthetic construct; identical to SEQ ID NO: 1222
  misc_feature 1..1156: note = Synthetic polypeptide
  source 1..1156: mol_type = other DNA

SEQ ID NO: 2566 - DNA, 919 bp, synthetic construct; identical to SEQ ID NO: 1223
  misc_feature 1..919: note = Synthetic polypeptide
  source 1..919: mol_type = other DNA

SEQ ID NO: 2567 - DNA, 941 bp, synthetic construct; identical to SEQ ID NO: 1224
  misc_feature 1..941: note = Synthetic polypeptide
  source 1..941: mol_type = other DNA

SEQ ID NO: 2568 - DNA, 577 bp, synthetic construct; identical to SEQ ID NO: 1112
  misc_feature 1..577: note = Synthetic polypeptide
  source 1..577: mol_type = other DNA

SEQ ID NO: 2569 - DNA, 252 bp, synthetic construct; identical to SEQ ID NO: 1113
  misc_feature 1..252: note = Synthetic polypeptide
  source 1..252: mol_type = other DNA

SEQ ID NO: 2570 - DNA, 1692 bp, synthetic construct; identical to SEQ ID NO: 1048
  misc_feature 1..1692: note = Synthetic polypeptide
  source 1..1692: mol_type = other DNA

SEQ ID NO: 2571 - DNA, 1695 bp, synthetic construct; identical to SEQ ID NO: 1049
  misc_feature 1..1695: note = Synthetic polypeptide
  source 1..1695: mol_type = other DNA

SEQ ID NO: 2572 - DNA, 466 bp, synthetic construct; identical to SEQ ID NO: 1050
  misc_feature 1..466: note = Synthetic polypeptide
  source 1..466: mol_type = other DNA

SEQ ID NO: 2573 - DNA, 2474 bp, synthetic construct; identical to SEQ ID NO: 1065
  misc_feature 1..2474: note = Synthetic polypeptide
  source 1..2474: mol_type = other DNA

SEQ ID NO: 2574 - DNA, 1694 bp, synthetic construct; identical to SEQ ID NO: 1066
  misc_feature 1..1694: note = Synthetic polypeptide
  source 1..1694: mol_type = other DNA

SEQ ID NO: 2575 - DNA, 1361 bp, synthetic construct; identical to SEQ ID NO: 1067
  misc_feature 1..1361: note = Synthetic polypeptide
  source 1..1361: mol_type = other DNA

SEQ ID NO: 2576 - DNA, 688 bp, synthetic construct; identical to SEQ ID NO: 1068
  misc_feature 1..688: note = Synthetic polypeptide
  source 1..688: mol_type = other DNA

SEQ ID NO: 2577 - DNA, 531 bp, synthetic construct; identical to SEQ ID NO: 1069
  misc_feature 1..531: note = Synthetic polypeptide
  source 1..531: mol_type = other DNA

SEQ ID NO: 2578 - DNA, 266 bp, synthetic construct
  misc_feature 1..266: note = Synthetic polypeptide
  source 1..266: mol_type = other DNA
atgaacccggtacctcagatggaaatgcagaaatcacccgtcttctgtgtcgctcacgctgggagctgtagaccggagctgttcctattcggacatcttggctcctccccaagagttctggagtctgagaagtcaaggatcggggtgctggcctattcagttcctggtaagggctgtcttcctggcttgcagttgaactacttcttgctgtgtcttcacaagtctcaggtatgtctttatcagcagcatgaaaatggactaataca

SEQ ID NO: 2579 - DNA, 897 bp, synthetic construct
  misc_feature 1..897: note = Synthetic polypeptide
  source 1..897: mol_type = other DNA
atggcccggctggctgactacttcatcgtggtaggctatgaccacgagaagccaggatcaggagaaggtctggggaaaataatccagagatttccacagaaggactgggatgatacaccttttccacagggaattgagttgttttgtcagcctggcgggtggcagctgtccagagagaggaagcagccaacgttctttgtggttgtcctgacagacattgactcagatcgacattactgctcatgcctaaccttctatgaggcagagatcaatcttcagggaacaaagaaggaagagattgaaggtgaagcaaaagtgtctggtttaattcagcctgcagaagtgtttgctcccaaaagcctggtgttggtatccagattatattatccagaaatttttagggcttgcctgggtttgatctataccgtgtatgtggacagcctgaatgtctccttggaaagtctaattgcaaacctttgtgcctgccttgtcccagcggctggagggtctcagaagctgttttctttgggtgcaggagatagacagttgatccagactcctttacatgatagtcttcctatcacgggcactagtgtggctctcctgttccagcaattgggcacggtggctcacgcctgtaatctcagcactttgggaggccgaggcgggcagctcacgaggtcaggagatcgagaccatcctggctaacacggtgaaatcccatctctactaaaaatacaaaaaattagccgggcatggtggcccgtgtctgcagtcccagctactcgggaggctgaggcaggagaatggcgtgaacccaagaggcggagcttgcagtgagctgagatcgcaccactacactccagactgggcgacagagcgagactccatctcaaa

SEQ ID NO: 2580 - DNA, 468 bp, synthetic construct
  misc_feature 1..468: note = Synthetic polypeptide
  source 1..468: mol_type = other DNA
atgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggctgggcacgcggtaggtcacacctgtaatcccggcacagtggatcacgaggtcaggagttcgagaccagcctgaccaatatggtgaaaccccatctctactaaaaatacaaaaattagctgggcgtagtggtgggcgcctgtggtcccagctgctcggaaggctgaggcaggagaatcgcttgaacctgggaggtggaggttgcagtgagccaagaccatgccactgcactccagcctgggcaacagagcaagactcttgtcttaaaaaacaaaaaa

SEQ ID NO: 2581 - DNA, 3995 bp, synthetic construct; identical to SEQ ID NO: 2035
  misc_feature 1..3995: note = Synthetic polypeptide
  source 1..3995: mol_type = other DNA

SEQ ID NO: 2582 - DNA, 3836 bp, synthetic construct; identical to SEQ ID NO: 2036
  misc_feature 1..3836: note = Synthetic polypeptide
  source 1..3836: mol_type = other DNA

SEQ ID NO: 2583 - DNA, 506 bp, synthetic construct; identical to SEQ ID NO: 1096
  misc_feature 1..506: note = Synthetic polypeptide
  source 1..506: mol_type = other DNA

SEQ ID NO: 2584 - DNA, 150 bp, synthetic construct; identical to SEQ ID NO: 384
  misc_feature 1..150: note = Synthetic polypeptide
  source 1..150: mol_type = other DNA

SEQ ID NO: 2585 - DNA, 390 bp, synthetic construct; identical to SEQ ID NO: 380
  misc_feature 1..390: note = Synthetic polypeptide
  source 1..390: mol_type = other DNA

SEQ ID NO: 2586 - DNA, 299 bp, synthetic construct; identical to SEQ ID NO: 383
  misc_feature 1..299: note = Synthetic polypeptide
  source 1..299: mol_type = other DNA

SEQ ID NO: 2587 - DNA, 718 bp, synthetic construct; identical to SEQ ID NO: 1366
  misc_feature 1..718: note = Synthetic polypeptide
  source 1..718: mol_type = other DNA

SEQ ID NO: 2588 - DNA, 755 bp, synthetic construct; identical to SEQ ID NO: 2148
  misc_feature 1..755: note = Synthetic polypeptide
  source 1..755: mol_type = other DNA

SEQ ID NO: 2589 - DNA, 290 bp, synthetic construct; identical to SEQ ID NO: 2149
  misc_feature 1..290: note = Synthetic polypeptide
  source 1..290: mol_type = other DNA

SEQ ID NO: 2590 - DNA, 800 bp, synthetic construct; identical to SEQ ID NO: 2150
  misc_feature 1..800: note = Synthetic polypeptide
  source 1..800: mol_type = other DNA

SEQ ID NO: 2591 - DNA, 281 bp, synthetic construct; identical to SEQ ID NO: 2151
  misc_feature 1..281: note = Synthetic polypeptide
  source 1..281: mol_type = other DNA

SEQ ID NO: 2592 - DNA, 620 bp, synthetic construct
  misc_feature 1..620: note = Synthetic polypeptide
  source 1..620: mol_type = other DNA
atgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaatctcctggaggaggtactctaccacagcaaagggtaaaccaagaagaaataatccactgggatctagaaagctgggagattcaattcaaggaatatatagggaaccctcaagaataggactgagggagatctcagaatggacatttatttaacagacccagagaacaaccagtccagtttggagataggtcaaggaagttgtatctccaagaagacaaacagaatgtttcatatctttaagcatattgagaagatatatacaactaggagagaatttgggcattaactcataataa

SEQ ID NO: 2593 - DNA, 1292 bp, synthetic construct
  misc_feature 1..1292: note = Synthetic polypeptide
  source 1..1292: mol_type = other DNA
atggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaatctcctggaggaggtactctaccacagcaaagggtaaaccaagaagaaataatccactgggatctagaaagctgggagattcaattcaaggaatatatagggaaccctcaagaataggactgagggagatctcagaatggacatttatttaacagacccagagaacaaccagtccagtttggagataggtcaaggaagttgtatctccaagaagacaaacagaatgtttcatatctttaagcatattgagaagatatatacaactaggagagaatttgggcattaactcataataa

SEQ ID NO: 2594 - DNA, 1400 bp, synthetic construct
  misc_feature 1..1400: note = Synthetic polypeptide
  source 1..1400: mol_type = other DNA
atggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaatctcctggaggaggtactctaccacagcaaagggtaaaccaagaagaaataatccactgggatctagaaagctgggagattcaattcaaggaatatatagggaaccctcaagaataggactgagggagatctcagaatggacatttatttaacagacccagagaacaaccagtccagtttggagataggtcaaggaagttgtatctccaagaagacaaacagaatgtttcatatctttaagcatattgagaagatatatacaactaggagagaatttgggcattaactcataataa

SEQ ID NO: 2595 - DNA, 1310 bp, synthetic construct
  misc_feature 1..1310: note = Synthetic polypeptide
  source 1..1310: mol_type = other DNA
atgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaatctcctggaggaggtactctaccacagcaaagggtaaaccaagaagaaataatccactgggatctagaaagctgggagattcaattcaaggaatatatagggaaccctcaagaataggactgagggagatctcagaatggacatttatttaacagacccagagaacaaccagtccagtttggagataggtcaaggaagttgtatctccaagaagacaaacagaatgtttcatatctttaagcatattgagaagatatatacaactaggagagaatttgggcattaactcataataa

SEQ ID NO: 2596 - DNA, 497 bp, synthetic construct
  misc_feature 1..497: note = Synthetic polypeptide
  source 1..497: mol_type = other DNA
gcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaatctcctggaggaggtactctaccacagcaaagggtaaaccaagaagaaataatccactgggatctagaaagctgggagattcaattcaaggaatatatagggaaccctcaagaataggactgagggagatctcagaatggacatttatttaacagacccagagaacaaccagtccagtttggagataggtcaaggaagttgtatctccaagaagacaaacagaatgtttcatatctttaagcatattgagaagatatatacaactaggagagaatttgggcattaactcataataa

SEQ ID NO: 2597 - DNA, 412 bp, synthetic construct
  misc_feature 1..412: note = Synthetic polypeptide
  source 1..412: mol_type = other DNA
aaaaagcgcatgctgaagaaagggaattatggaagacagaacatgcaaaagatcaagaaaaagtatctcaggaaattcaaaaagctatacaagaacaaagaaaaataagtcaggaatctcctggaggaggtactctaccacagcaaagggtaaaccaagaagaaataatccactgggatctagaaagctgggagattcaattcaaggaatatatagggaaccctcaagaataggactgagggagatctcagaatggacatttatttaacagacccagagaacaaccagtccagtttggagataggtcaaggaagttgtatctccaagaagacaaacagaatgtttcatatctttaagcatattgagaagatatatacaactaggagagaatttgggcattaactcataataa

SEQ ID NO: 2598 - DNA, 1928 bp, synthetic construct
  misc_feature 1..1928: note = Synthetic polypeptide
  source 1..1928: mol_type = other DNA
atgcaatcccggcttctactcctcggggcacccggaggccacggcggcccggcctcgcggcgcatgcggctgctcctgcggcaggtggtgcagcgcaggccgggtggcgacaggcagcggccggaggtcagactgttgcacgccggctcgggggccgacacaggtgatacagttaatattggagatgtatcctacaagttgaaaattcctaagaatccagaacttgtgccacagaactacatttcagactctctggctcaatctgtagttcagcatctaagatggataatgcagaaggatcttttggggcaagatgtttttctaataggacctcctgggcctcttcgacgctctattgctatgcagtacttggagctgaccaaacgggaggtcgaatacattgccctgtcaagggacaccactgaaactgatctcaaacagcgacgagagatccgtgcaggcacagccttttacattgatcagtgtgcagttcgtgcagccacagaaggcagaactctcattttggaaggtttggaaaaggcagagaggaatgttttgcctgttttgaacaacttgctggaaaacagagagatgcagcttgaagatggacgcttcctgatgtctgctgagcgttacgacaaacttctccgagatcataccaaaaaagagttggattcttggaaaattgtccgagttagtgaaaatttccgagtgattgccttgggcttgccagtgccaaggtattctgggaatccattagacccccctcttcgttctcgatttcaagccagggatatttattatttacccttcaaggaccaacttaagttgttatattcaattggagccaatgtttctgctgagaaagtttctcagctcttgtcctttgccacaactctgtgttcccaagaatcttctactcttggacttccagactttcctttagatagtttagcagctgcggttcaaatcttggattcctttcctatgatgccaatcaaacatgcaatccagtggctttatccatatagtattttactaggtcatgaagggaagatggctgtggaaggtgttttaaaggaagtgaggagcgtctctgcccggccgcccatcgtctgagatgtggggagagcctctgccctgccgccccgtctgggatgtgaggagcacctccacccggccgcgaccccgtctgggaggtgaggagcgtctctgcccggccgccccgtctgagaagtgaggagaccctccgcctggcaaccgcccgtctgagaagtgaggagcccctccgcccggaagccgccccatctgagaagtgaggagcccctccgtcccggcagtcaccctgtctgggaagtgaggagcgtctccgcccagcagccaccccgtccgggagggaggtgggggtcagcccccgccaggccagccgccccgtccgggagggaggtgggggggtcagccccccgcccggccagccgccccgtccgggaggtgaggggcacctctgcccggccgcccctactgggaagtgaggagctcctctgcccagccagtcgccccgtccaggagggaggtgggggggtcagcccccagcccggccagccgccccgtccgggaggtgaggggcgcctctgcccggccgcccctactgggaagtgaggagccctctgcccagccgcccctactgggaagtgaggagcccctctgcctggccaccaccccgtctgggaggtgtacccaacagctcattgagaacgggccatgatgacaatggcggttttgtggaacagaaggggggaaaggtggggaaaagattgagaaatcggatggttgccgtgtctgtgtagaaagaggtagacatgggagacttttcattttgttctgtactaagaaaaattcttatcctgttgatctgtgaccttaccccc

SEQ ID NO: 2599 - DNA, 728 bp, synthetic construct
  misc_feature 1..728: note = Synthetic polypeptide
  source 1..728: mol_type = other DNA
atgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggctggaatgtagaagtggacttttggccacgtggatgaggaattgaagcagtcagttctgatctagagatggaaggcgcctgctgaggacagcagggctgcttggcaccctgggtccctgaatggctctgtggagcactgcctgatggcccaccctggactgttgcctgagacagaaataaacttttatcttgtttcaaacactgcattttggtgtttcct

SEQ ID NO: 2600 - DNA, 428 bp, synthetic construct
  misc_feature 1..428: note = Synthetic polypeptide
  source 1..428: mol_type = other DNA
atgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcaggcctgctatttaccctgggttatccttggattcaactatatcatcggaggctcggctggaatgtagaagtggacttttggccacgtggatgaggaattgaagcagtcagttctgatctagagatggaaggcgcctgctgaggacagcagggctgcttggcaccctgggtccctgaatggctctgtggagcactgcctgatggcccaccctggactgttgcctgagacagaaataaacttttatcttgtttcaaacactgcattttggtgtttcct

SEQ ID NO: 2601 - DNA, 428 bp, synthetic construct
  misc_feature 1..428: note = Synthetic polypeptide
  source 1..428: mol_type = other DNA
atgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggctggaatgtagaagtggacttttggccacgtggatgaggaattgaagcagtcagttctgatctagagatggaaggcgcctgctgaggacagcagggctgcttggcaccctgggtccctgaatggctctgtggagcactgcctgatggcccaccctggactgttgcctgagacagaaataaacttttatcttgtttcaaacactgcattttggtgtttcct

SEQ ID NO: 2602 - DNA, 193 bp, synthetic construct
  misc_feature 1..193: note = Synthetic polypeptide
  source 1..193: mol_type = other DNA
atggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacagtaagtgctgcataagtggagctatta

SEQ ID NO: 2603 - DNA, 1822 bp, synthetic construct
  misc_feature 1..1822: note = Synthetic polypeptide
  source 1..1822: mol_type = other DNA
atggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtattaccaccttgctcttgactggaaatgcaactgtggttaccacctgtgctgcagcagggcgtggtggcgcaggctttgtagtcccagatactctggaggctgaggcccaggaggacgaggctgcagggagccatgatcacgccactgcactccaccctgggcgacagagcgagaccttgtctcagaaaaaa

SEQ ID NO: 2604 - DNA, 1368 bp, synthetic construct
  misc_feature 1..1368: note = Synthetic polypeptide
  source 1..1368: mol_type = other DNA
cccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagagccgagggtgtggagtatgccggggctgtcagacccaagaggattgtggccattgccccatctgccttcgccctccccgccctggtctcaggcgccagtggaaatgtgtccagcgacgttgcctacggcaccttgctcaccgcctgcgtcgccgtcatcagagatgtcagcgacgcactcccctggctgtggctcccccaactggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtattaccaccttgctcttgactggaaatgcaactgtggttaccacctgtgctgcagcagggcgtggtggcgcaggctttgtagtcccagatactctggaggctgaggcccaggaggacgaggctgcagggagccatgatcacgccactgcactccaccctgggcgacagagcgagaccttgtctcagaaaaaa

SEQ ID NO: 2605 - DNA, 1655 bp, synthetic construct
  misc_feature 1..1655: note = Synthetic polypeptide
  source 1..1655: mol_type = other DNA
atgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcagccgcctgccttggcctcccaaagtgccgagattgcagcctctgcctggctgccaccccatctgggaagtgaggagcgtctctgcctggccgcccatcgtctgggatgtgaggagcccctctgcccggccgcccagtcttggaagtgaggagcgcatcttcccggccgccatcacgtctgggaagtgaggagcgtctctgcccggctgcccatcgtctcagatgtggggagcacctctgccccgccgccccgtctgggatgtgaggagcgcctctgtccggccgcgacccggtctgggaactgaggagtgtctctgcccgaccgccaccccgtctgggaggtgaggagcgtctttgcccagccgccccgtctgagaagtgaggagcccctccgcctggcagccgccccgtctgggaagtgaggagcgtctccgcccggcagccgccccgtccgggaggtggggggcagccgccgcccggccagccgccctgtccaggagggaggtggggggcaacccccgcccggccagccaccccgtccgggagggaggttgggggtgcctctgaccggccgccccgtctgggaagtgaggagcccctctgcccggcggccaccccgtctgggaggagtacccaacagctcgttgagaacgggccatgatgacgatggcggttttgtcgaatagaaaagggggaaatgtggggaaaagaaagagagatcagattgttactgtgtctgtgtggaaagaggtagacatgggagactccattttgttctgtactaagaaaaattcttctgccttgggatgctgttaatctataaccttacccccaaccccgtgctctctgaaacatgtgctgtgtccactcagggttaaatggataaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacccttgttcacatgtttatctgctgaccttccctccactattgtcctatgaccctgccaaatccccctctccgagaaacacccaagaatgatcaataaatactattaaaaaaaaaaa

SEQ ID NO: 2606 - DNA, 3723 bp, synthetic construct; identical to SEQ ID NO: 1743
  misc_feature 1..3723: note = Synthetic polypeptide
  source 1..3723: mol_type = other DNA

SEQ ID NO: 2607 - DNA, 3708 bp, synthetic construct; identical to SEQ ID NO: 1744
  misc_feature 1..3708: note = Synthetic polypeptide
  source 1..3708: mol_type = other DNA

SEQ ID NO: 2608 - DNA, 3333 bp, synthetic construct; identical to SEQ ID NO: 1745
  misc_feature 1..3333: note = Synthetic polypeptide
  source 1..3333: mol_type = other DNA

SEQ ID NO: 2609 - DNA, 610 bp, synthetic construct
  misc_feature 1..610: note = Synthetic polypeptide
  source 1..610: mol_type = other DNA
atgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccggcacccagcacatagaaagtctttggtgaatgaatga

SEQ ID NO: 2610 - DNA, 734 bp, synthetic construct; identical to SEQ ID NO: 930
  misc_feature 1..734: note = Synthetic polypeptide
  source 1..734: mol_type = other DNA

SEQ ID NO: 2611 - DNA, 364 bp, synthetic construct
  misc_feature 1..364: note = Synthetic polypeptide
  source 1..364: mol_type = other DNA
atgaccgaaggggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgccatactgtaagctccaggacagcaaagaccatgcctgttttatacccgctacatccccagtgcctgaaaaagaacagatgctcaggacatatttattgactgaatgaat

SEQ ID NO: 2612 - DNA, 373 bp, synthetic construct
  misc_feature 1..373: note = Synthetic polypeptide
  source 1..373: mol_type = other DNA
atgggcaatggcatgaccaaggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgccatactgtaagctccaggacagcaaagaccatgcctgttttatacccgctacatccccagtgcctgaaaaagaacagatgctcaggacatatttattgactgaatgaat

SEQ ID NO: 2613 - DNA, 339 bp, synthetic construct
  misc_feature 1..339: note = Synthetic polypeptide
  source 1..339: mol_type = other DNA
atgggcaatggcatgaccaagatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgccatactgtaagctccaggacagcaaagaccatgcctgttttatacccgctacatccccagtgcctgaaaaagaacagatgctcaggacatatttattgactgaatgaat

SEQ ID NO: 2614 - DNA, 1091 bp, synthetic construct
  misc_feature 1..1091: note = Synthetic polypeptide
  source 1..1091: mol_type = other DNA
atggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggttgttgtgattactcaggaaagcaagactagtcaagcactttgcacagggcctggcacatagtagatgctcaacaaatactgctgtgtt

SEQ ID NO: 2615 - DNA, 1118 bp, synthetic construct
  misc_feature 1..1118: note = Synthetic polypeptide
  source 1..1118: mol_type = other DNA
atggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggttgttgtgattactcaggaaagcaagactagtcaagcactttgcacagggcctggcacatagtagatgctcaacaaatactgctgtgtt

SEQ ID NO: 2616 - DNA, 1325 bp, synthetic construct
  misc_feature 1..1325: note = Synthetic polypeptide
  source 1..1325: mol_type = other DNA
atggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggttgttgtgattactcaggaaagcaagactagtcaagcactttgcacagggcctggcacatagtagatgctcaacaaatactgctgtgtt

SEQ ID NO: 2617 - DNA, 1229 bp, synthetic construct
  misc_feature 1..1229: note = Synthetic polypeptide
  source 1..1229: mol_type = other DNA
atggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggttgttgtgattactcaggaaagcaagactagtcaagcactttgcacagggcctggcacatagtagatgctcaacaaatactgctgtgtt

SEQ ID NO: 2618 - DNA, 2761 bp, synthetic construct
  misc_feature 1..2761: note = Synthetic polypeptide
  source 1..2761: mol_type = other DNA
atgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcaggaaattctgctggctctaaggccatcaaactgtgcccagaatgtggcccctcctcagcatctccagtgctaccaccgagatggtccacgatgccatcatctctcacctgcactactacaggtctccctgtttccagctcagcccccaccccagtctagtcccagtgtgtcagccagggctgtctttttacaacataaggcagaccacaccacttctttgctccaatcctcccatttcactcagaagaaaagctccgacaacagctgcaaagccgtgcacgacctgcgcccctcccctgcctccttaatttgctgactgcaccgcagccacacggacgtctttcttgtcccttgaatgcgctgggcctgctcttgccttgggacctttctgtgcattgcttagtctgctcagaagccttctcctctacatatccacttgtctaaaccctctacctccaccttcatgccccttctcagcgaggtctaccatgaccatgctgcctacaaattcagtctccccttctgtactttgacgtactttatagtgctgatcacaattgaacgtcatacatattttgttttctttattatctgagtcctccaactagaatgaaagattttgcccattatggtttccctagtgccaagaacagtacctggcacataccaggggctcagtaaacatttgttagatgaatgaa

SEQ ID NO: 2619 - DNA, 2248 bp, synthetic construct
  misc_feature 1..2248: note = Synthetic polypeptide
  source 1..2248: mol_type = other DNA
atgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcaggaaattctgctggctctaaggccatcaaactgtgcccagaatgtggcccctcctcagcatctccagtgctaccaccgagatggtccacgatgccatcatctctcacctgcactactacaggtctccctgtttccagctcagcccccaccccagtctagtcccagtgtgtcagccagggctgtctttttacaacataaggcagaccacaccacttctttgctccaatcctcccatttcactcagaagaaaagctccgacaacagctgcaaagccgtgcacgacctgcgcccctcccctgcctccttaatttgctgactgcaccgcagccacacggacgtctttcttgtcccttgaatgcgctgggcctgctcttgccttgggacctttctgtgcattgcttagtctgctcagaagccttctcctctacatatccacttgtctaaaccctctacctccaccttcatgccccttctcagcgaggtctaccatgaccatgctgcctacaaattcagtctccccttctgtactttgacgtactttatagtgctgatcacaattgaacgtcatacatattttgttttctttattatctgagtcctccaactagaatgaaagattttgcccattatggtttccctagtgccaagaacagtacctggcacataccaggggctcagtaaacatttgttagatgaatgaa

SEQ ID NO: 2620 - DNA, 2656 bp, synthetic construct
  misc_feature 1..2656: note = Synthetic polypeptide
  source 1..2656: mol_type = other DNA
atgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcaggaaattctgctggctctaaggccatcaaactgtgcccagaatgtggcccctcctcagcatctccagtgctaccaccgagatggtccacgatgccatcatctctcacctgcactactacaggtctccctgtttccagctcagcccccaccccagtctagtcccagtgtgtcagccagggctgtctttttacaacataaggcagaccacaccacttctttgctccaatcctcccatttcactcagaagaaaagctccgacaacagctgcaaagccgtgcacgacctgcgcccctcccctgcctccttaatttgctgactgcaccgcagccacacggacgtctttcttgtcccttgaatgcgctgggcctgctcttgccttgggacctttctgtgcattgcttagtctgctcagaagccttctcctctacatatccacttgtctaaaccctctacctccaccttcatgccccttctcagcgaggtctaccatgaccatgctgcctacaaattcagtctccccttctgtactttgacgtactttatagtgctgatcacaattgaacgtcatacatattttgttttctttattatctgagtcctccaactagaatgaaagattttgcccattatggtttccctagtgccaagaacagtacctggcacataccaggggctcagtaaacatttgttagatgaatgaa

SEQ ID NO: 2621 - DNA, 995 bp, synthetic construct
  misc_feature 1..995: note = Synthetic polypeptide
  source 1..995: mol_type = other DNA
accgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcaggaaattctgctggctctaaggccatcaaactgtgcccagaatgtggcccctcctcagcatctccagtgctaccaccgagatggtccacgatgccatcatctctcacctgcactactacaggtctccctgtttccagctcagcccccaccccagtctagtcccagtgtgtcagccagggctgtctttttacaacataaggcagaccacaccacttctttgctccaatcctcccatttcactcagaagaaaagctccgacaacagctgcaaagccgtgcacgacctgcgcccctcccctgcctccttaatttgctgactgcaccgcagccacacggacgtctttcttgtcccttgaatgcgctgggcctgctcttgccttgggacctttctgtgcattgcttagtctgctcagaagccttctcctctacatatccacttgtctaaaccctctacctccaccttcatgccccttctcagcgaggtctaccatgaccatgctgcctacaaattcagtctccccttctgtactttgacgtactttatagtgctgatcacaattgaacgtcatacatattttgttttctttattatctgagtcctccaactagaatgaaagattttgcccattatggtttccctagtgccaagaacagtacctggcacataccaggggctcagtaaacatttgttagatgaatgaa

SEQ ID NO: 2622 - DNA, 307 bp, synthetic construct
  misc_feature 1..307: note = Synthetic polypeptide
  source 1..307: mol_type = other DNA
atgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcgggtgtgatggcgggcatctgtaatcccaactgctggagaggctgaggcaggagaatcgcttgaatccaggaggcggaggttgcagtgagttgagatcacgccattgcattccagcctgggcgacacagcgagactccatctcaaaaaagaaaaagaaaaagaaaaa

SEQ ID NO: 2623 - DNA, 123 bp, synthetic construct
  misc_feature 1..123: note = Synthetic polypeptide
  source 1..123: mol_type = other DNA
atgaaaagaaatacctgtgatttgctttctcggagcaaaagtgacttgagcatctgaagattttggtttctgcagagggtgggaaaggttgaaccaatcccccatggataccaaggtaaaact

SEQ ID NO: 2624 - DNA, 130 bp, synthetic construct
  misc_feature 1..130: note = Synthetic polypeptide
  source 1..130: mol_type = other DNA
atgagaacttcctaccttctgctgtttactctctgcttacttttgtctgagatggcctcagaatgaggggctgggaaggatgatcctgaaagcaagcactccagttcagaaagtctctgtaagatcctat

SEQ ID NO: 2625 - DNA, 2647 bp, synthetic construct
  misc_feature 1..2647: note = Synthetic polypeptide
  source 1..2647: mol_type = other DNA
atggcttcactgagaagagtcaaagtgctgttggtgttgaacttgatcgcggtagccggcttcgtgctcttcctggccaagtgccggcccatcgcggtgcgcagcggagacgccttccacgagatccggccgcgcgccgaggtggccaacctcagcgcgcacagcgccagccccatccaggatgcggtcctgaagcgcctgtcgctgctggaggacatcgtgtaccggcagctgaatggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctgggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggaccccagccatgataggctgctcgttcgtggtcaacaggaagttcttcggtgaaattggtcttctggatcctggcatggatgtatacggaggagaaaatattgaactgggaatcaaggtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggagaatccgggaattgacatcggtgatgtctccgaaagaagagcattaaggaaaagtttaaagtgtaagaatttccagtggtacctggaccatgtttacccagaaatgagaagatacaataataccgttgcttacggggagcttcgcaacaacaaggcaaaagacgtctgcttggaccaggggccgctggagaaccacacagcaatattgtatccgtgccatggctggggaccacagaaatggaaaagctaatcctaaaatacatatgaaattcaagggacacaaaatagccagaacagtattgaaaaagaacaaagttgcaagactcacacttcccagttctaagacttgctacaaagctataataatcaaagcagtatagtgtggcacaaagatagacgtggagatcaaaggaatcacatttagagtctagaaacaaaccctcacatttatagtccattgatttttgacaagagtgacaagacaattcaataaggaaagaatagtcttttcagcaatggtgccgggacacagatatccacatgaaaaagagtgaatttggacctcaaccttatactatacagaaaaaaaattcaaagggcatcaaagacctaaatataagagatgaaactataaaattcttagaaaacacaggggtaaatcttcatggccttggattttgcaatggtttcttagatatgacttcaaaaccacaaataaccaaagaaaaaaatagctactttgtattttaccaaaaagaaaaactttgatgcttcaaaggacattatcaagcaagtgaaaaacaacccacagaatgggagaaaatatttgtacatcatatgtcagaaaaatgtcttagtatccagaatatgtaaagaactcttaaaactcaaaaataagaagacaaataaccctttttttgatggtcaaaagagttgaatagacttttttttcaaagaagatataaaacggtcaataagcaaatgaaaagatgctcaacatctttagtcattagagaaatgcaaattaaaaccacagtggccacttcacactcctactaggatgactagaatcaaaaaaagcagacaataacatgagttggccaggatgtggagaaattgaaaccccggttcattgctggtgggagtgtaaaatggtacagctgctttggaaaatagtttggcagttccgtagaaagttaaacatagagttaccatatggcccaaggatgagtaattctactcctaggtgtatacctcagagaattgaaaacatatgttcatatgaaaattgtacatgaatatccacagcagcatcattcataatagccaaagaatggaaacaaccccaatgtccatcagcttgaaaatgaataaacaaaatg

SEQ ID NO: 2626 - DNA, 440 bp, synthetic construct
  misc_feature 1..440: note = Synthetic polypeptide
  source 1..440: mol_type = other DNA
atgaccgaaggggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgcccccagactcatcctcaaagctattatcaccacctggaattgattatctgatcaacgtctgtcccccccccccagccatactgtaagctccaggacagcaaagaccatgcctgttttatacccgctacatccccagtgcctgaaaaagaacagatgctcaggacatatttattgactgaatgaat

SEQ ID NO: 2627 - DNA, 449 bp, synthetic construct
  misc_feature 1..449: note = Synthetic polypeptide
  source 1..449: mol_type = other DNA
atgggcaatggcatgaccaaggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgcccccagactcatcctcaaagctattatcaccacctggaattgattatctgatcaacgtctgtcccccccccccagccatactgtaagctccaggacagcaaagaccatgcctgttttatacccgctacatccccagtgcctgaaaaagaacagatgctcaggacatatttattgactgaatgaat

SEQ ID NO: 2628 - DNA, 415 bp, synthetic construct
  misc_feature 1..415: note = Synthetic polypeptide
  source 1..415: mol_type = other DNA
atgggcaatggcatgaccaagatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgcccccagactcatcctcaaagctattatcaccacctggaattgattatctgatcaacgtctgtcccccccccccagccatactgtaagctccaggacagcaaagaccatgcctgttttatacccgctacatccccagtgcctgaaaaagaacagatgctcaggacatatttattgactgaatgaat

SEQ ID NO: 2629 - DNA, 171 bp, synthetic construct
  misc_feature 1..171: note = Synthetic polypeptide
  source 1..171: mol_type = other DNA
atgctaggagcgatgcaggtttccaaatatggtgacctggctaactggatgatacctgcaacaagcttttccaggagaaggaccttgttttgatctgactctagcaccctagtatacagcaacacttatactagacattcagtaagttgaattgattgaagataagtgaat

SEQ ID NO: 2630 - DNA, 1362 bp, synthetic construct
  misc_feature 1..1362: note = Synthetic polypeptide
  source 1..1362: mol_type = other DNA
atggcggctctcaaactcctctcctccgggcttcggctctgcgcctctgcccgcggatctggggcaacctggtacaagggatgtgtttgttccttttccaccagtgctcatcgccataccaagttttatacagatccagtagaagctgtaaaagacatccctgatggtgccacggttttggttggtggttttgggctatgtggaattccagagaatcttatagatgctttactgaaaactggagtaaaaggactaactgcagtcagcaacaatgcaggggttgacaattttggtttggggcttttgcttcggtccaagcagataaaacgcatggtctcttcatatgtgggagaaaatgcagaatttgaacgacagtacttatctggtgaattagaagtggagctgacaccacagggcacacttgcagagaggatccgtgcaggcggggctggagttcctgcattttacaccccaacagggtatgggaccctggtacaagaaggaggatcgcccatcaaatacaacaaagatggcagtgttgccattgccagtaagccaagagaggtgagggagttcaatggtcagcactttattttggaggaagcaattacaggggattttgctttggtgaaagcctggaaggcggaccgagcaggaaacgtgattttcaggaaaagtgcaaggaatttcaacttgccaatgtgcaaagctgcagaaaccacagtggtagaggttgaagaaattgtggatattggagcatttgctccagaagacatccatattcctcagatttatgtacatcgccttataaagggagaaaaatatgagaaaagaattgagcgtttatcaatccggaaagagggagatggggaagccaaatctgctaaacctggagatgacgtaagggaacgaatcatcaagagggccgctcttgagtttgaggatggcatgtatgctaatttgggcataggaatccctctcctggccagcaattttatcagcccaaatataactgttcatcttcaaagtgaaaatggagttctgggtttgggtccatatccacgacaacatgaagctgatgcagatctcatcaatgcaggcaaggaaacagttactattcttccaggagcctcttttttctccagcgatgaatcatttgcaatgattagaggtggacacgtcgatctgacaatgctaggagcgatgcaggtttccaaatatggtgacctggctaactggatgatacctgcaacaagcttttccaggagaaggaccttgttttgatctgactctagcaccctagtatacagcaacacttatactagacattcagtaagttgaattgattgaagataagtgaat

SEQ ID NO: 2631 - DNA, 804 bp, synthetic construct
  misc_feature 1..804: note = Synthetic polypeptide
  source 1..804: mol_type = other DNA
atgatggtgagggagttcaatggtcagcactttattttggaggaagcaattacaggggattttgctttggtgaaagcctggaaggcggaccgagcaggaaacgtgattttcaggaaaagtgcaaggaatttcaacttgccaatgtgcaaagctgcagaaaccacagtggtagaggttgaagaaattgtggatattggagcatttgctccagaagacatccatattcctcagatttatgtacatcgccttataaagggagaaaaatatgagaaaagaattgagcgtttatcaatccggaaagagggagatggggaagccaaatctgctaaacctggagatgacgtaagggaacgaatcatcaagagggccgctcttgagtttgaggatggcatgtatgctaatttgggcataggaatccctctcctggccagcaattttatcagcccaaatataactgttcatcttcaaagtgaaaatggagttctgggtttgggtccatatccacgacaacatgaagctgatgcagatctcatcaatgcaggcaaggaaacagttactattcttccaggagcctcttttttctccagcgatgaatcatttgcaatgattagaggtggacacgtcgatctgacaatgctaggagcgatgcaggtttccaaatatggtgacctggctaactggatgatacctgcaacaagcttttccaggagaaggaccttgttttgatctgactctagcaccctagtatacagcaacacttatactagacattcagtaagttgaattgattgaagataagtgaat

SEQ ID NO: 2632 - DNA, 719 bp, synthetic construct
  misc_feature 1..719: note = Synthetic polypeptide
  source 1..719: mol_type = other DNA
atggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccgtaagtttattttctggagagggtcagtctttaggctggggtatgcaggcacatttgaaaacatgtacgtactatacgtgaggaccccactccctccctagcttccttcttcctctcaactcccagaattctggcagtcaggcttcagacttttcaggcaggatattagaagattgttttagaggaatctgtcctgcctaagaggaaagagctaaaggtttgtccagtaaaacagctgcatagggtcatctggtaaaataaagcccacagtagataaatcccagggcactcacccagaggttccagtcaacttttggtgccccactcttgaatatgggctgataaccaaagggtcaccagac

SEQ ID NO: 2633 - DNA, 668 bp, synthetic construct
  misc_feature 1..668: note = Synthetic polypeptide
  source 1..668: mol_type = other DNA
atggccttcatggagaagccgccagccggcaaggtgctgctggacgacacggtgccgctgacagcagccatcgaggcgagccagagcctgcagtcccacacgattgttagaagatacagtgactttgatttgcttaacaacagcttacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccgtaagtttattttctggagagggtcagtctttaggctggggtatgcaggcacatttgaaaacatgtacgtactatacgtgaggaccccactccctccctagcttccttcttcctctcaactcccagaattctggcagtcaggcttcagacttttcaggcaggatattagaagattgttttagaggaatctgtcctgcctaagaggaaagagctaaaggtttgtccagtaaaacagctgcatagggtcatctggtaaaataaagcccacagtagataaatcccagggcactcacccagaggttccagtcaacttttggtgccccactcttgaatatgggctgataaccaaagggtcaccagac

SEQ ID NO: 2634 - DNA, 692 bp, synthetic construct
  misc_feature 1..692: note = Synthetic polypeptide
  source 1..692: mol_type = other DNA
atgaagtgtgactccagagcctacttgttgggacagcagagtgtaagtggctggggtctgcagccccgtttccaggaatatattattcgagtgcaaagaggaatttctgtggaaaacagctggcagattgttagaagatacagtgactttgatttgcttaacaacagcttacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccgtaagtttattttctggagagggtcagtctttaggctggggtatgcaggcacatttgaaaacatgtacgtactatacgtgaggaccccactccctccctagcttccttcttcctctcaactcccagaattctggcagtcaggcttcagacttttcaggcaggatattagaagattgttttagaggaatctgtcctgcctaagaggaaagagctaaaggtttgtccagtaaaacagctgcatagggtcatctggtaaaataaagcccacagtagataaatcccagggcactcacccagaggttccagtcaacttttggtgccccactcttgaatatgggctgataaccaaagggtcaccagac

SEQ ID NO: 2635 - DNA, 1413 bp, synthetic construct
  misc_feature 1..1413: note = Synthetic polypeptide
  source 1..1413: mol_type = other DNA
atggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgggtcttactctttgcccaggctggagtgcagtggcgcgatcatggctcgttgcaacctcgaccacctgggctcaagtgatcctcccacctcagcctctcaagtagctgagattatagtgaactccggagacggcattgactacagccagcagaagagggagaacattggggacttgatccaggagacactggaggccttcgagcgctacggaggagaaaatgcctttatcaacattaagtgacccgaccaatcccacggattcacatgccgtctgtgcatggccgattctcacatttgctctctggcctcaacttccccagcgcctgctgggcatttcccccaggatgccgaagagatcgatccaaaccgaatgcatggacccacctgactcccgccactctccgaccccgcaccctctccccgcggagggctccagctcagtgaacaggagctcacgtcaccacggggaccaaaatgccgggattcatcctcctttttttccacgtctgcacccagtccagtacaaatcctgtctacgacaccttcaagatctgcatctgaccaagtcccagcccctcgtcctcactctagtccaggtccctggctcccccagctgacccccaaccttgcaaggggtggccggatcctctacccggaagtcagtgaccctttaaacgccaataaggtccccatgctctcaaccctccaacggcttctgcctcccagctggggcacattccagatctctgctgcgggtgatgtgcggcctgaaggatgtggccctggttcctcctgagct

SEQ ID NO: 2636 - DNA, 1296 bp, synthetic construct
  misc_feature 1..1296: note = Synthetic polypeptide
  source 1..1296: mol_type = other DNA
atggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgtgaactccggagacggcattgactacagccagcagaagagggagaacattggggacttgatccaggagacactggaggccttcgagcgctacggaggagaaaatgcctttatcaacattaagtgacccgaccaatcccacggattcacatgccgtctgtgcatggccgattctcacatttgctctctggcctcaacttccccagcgcctgctgggcatttcccccaggatgccgaagagatcgatccaaaccgaatgcatggacccacctgactcccgccactctccgaccccgcaccctctccccgcggagggctccagctcagtgaacaggagctcacgtcaccacggggaccaaaatgccgggattcatcctcctttttttccacgtctgcacccagtccagtacaaatcctgtctacgacaccttcaagatctgcatctgaccaagtcccagcccctcgtcctcactctagtccaggtccctggctcccccagctgacccccaaccttgcaaggggtggccggatcctctacccggaagtcagtgaccctttaaacgccaataaggtccccatgctctcaaccctccaacggcttctgcctcccagctggggcacattccagatctctgctgcgggtgatgtgcggcctgaaggatgtggccctggttcctcctgagct

SEQ ID NO: 2637 - DNA, 2466 bp, synthetic construct; identical to SEQ ID NO: 1682
  misc_feature 1..2466: note = Synthetic polypeptide
  source 1..2466: mol_type = other DNA

SEQ ID NO: 2638 - DNA, 1806 bp, synthetic construct; identical to SEQ ID NO: 1683
  misc_feature 1..1806: note = Synthetic polypeptide
  source 1..1806: mol_type = other DNA

SEQ ID NO: 2639 - DNA, 2412 bp, synthetic construct; identical to SEQ ID NO: 1684
  misc_feature 1..2412: note = Synthetic polypeptide
  source 1..2412: mol_type = other DNA

SEQ ID NO: 2640 - DNA, 2211 bp, synthetic construct; identical to SEQ ID NO: 1685
  misc_feature 1..2211: note = Synthetic polypeptide
  source 1..2211: mol_type = other DNA

SEQ ID NO: 2641 - DNA, 364 bp, synthetic construct; identical to SEQ ID NO: 1686
  misc_feature 1..364: note = Synthetic polypeptide
  source 1..364: mol_type = other DNA

SEQ ID NO: 2642 - DNA, 1288 bp, synthetic construct
  misc_feature 1..1288: note = Synthetic polypeptide
  source 1..1288: mol_type = other DNA
atgagtgaaggggcggccgctgcctcgccacctggtgccgcttcggcagccgccgcctcggccgaggagggcaccgcggcggctgcggcggcggcagcggcgggcgggggcccggacggcggcggcgaaggggcggccgagcccccccgggagttacgctgtagcgactgcatcgtgtggaaccggcagcagacgtggctgtgcgtggtacctctgttcatcggcttcatcggcctggggctcagcctcatgcttctcaaatggatcgtggtgggctccgtcaaggagtacgtgcccaccgacctagtggactccaaggggatgggccaggaccccttcttcctctccaagcccagctctttccccaaggccatggagaccaccaccactaccacttccaccacgtcccccgccaccccctccgccgggggtgccgcctcctccaggacgcccaaccggattagcactcgcctgaccaccatcacgcgggcgcccactcgcttccccgggcaccgggtgcccatccgggccagcccgcgctccaccacagcacggaacactgcggcccctgcgacggtcccgtccaccacggccccgttcttcagtagcagcacgctgggctcccgacccccggtgccaggaactccaagtacccaggcaatgccctcctggcctactgcggcatacgctacctcctcctaccttcacgattctactccctcctggaccctgtctccctttcaggatgctgcctcctcttcttcctcttcttcctcctccgctaccaccaccacaccagaaactagcaccagccccaaatttcatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaataaaa

SEQ ID NO: 2643 - DNA, 625 bp, synthetic construct
  misc_feature 1..625: note = Synthetic polypeptide
  source 1..625: mol_type = other DNA
atggagtgtggtatacctccaacccttgtatgcgttgggagaggagggggactacacacgatcaatataatcatctggtattattttccttctgcctggaggacttgctttaacatttcaagtagtgtgggtctgctgctgacgaattcatacaaattttatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaataaaa

SEQ ID NO: 2644 - DNA, 700 bp, synthetic construct
  misc_feature 1..700: note = Synthetic polypeptide
  source 1..700: mol_type = other DNA
atggagtgtggtatacctccaacccttgtatgcgttgggagaggagggggactacacacggtaggggtatttcatgttctttctcaattgatttccttgtgtaccattccggaggtctttaaagaaaagcccaagatcaatataatcatctggtattattttccttctgcctggaggacttgctttaacatttcaagtagtgtgggtctgctgctgacgaattcatacaaattttatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaataaaa

SEQ ID NO: 2645 - DNA, 778 bp, synthetic construct
  misc_feature 1..778: note = Synthetic polypeptide
  source 1..778: mol_type = other DNA
atggagtgtggtatacctccaacccttgtatgcgttgggagaggagggggactacacacggtaggggtatttcatgttctttctcaattgatttccttgtgtaccattccggaggtctttaaagaaaagcccaagatcaatataatcatctggtattattttccttctgcctggaggacttgctttaacatttcaagtagtgtgggtctgctgctgacgaattcatacaaattttgtcctagagacaggaggcatgccatacatggcaacatggggaagaccagagtggtcaggaggcagaaacaggagcaagatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaataaaa

SEQ ID NO: 2646 - DNA, 238 bp, synthetic construct
  misc_feature 1..238: note = Synthetic polypeptide
  source 1..238: mol_type = other DNA
atggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaataaaa

SEQ ID NO: 2647 - DNA, 750 bp, synthetic construct; identical to SEQ ID NO: 1060
  misc_feature 1..750: note = Synthetic polypeptide
  source 1..750: mol_type = other DNA

SEQ ID NO: 2648 - DNA, 296 bp, synthetic construct; identical to SEQ ID NO: 1061
  misc_feature 1..296: note = Synthetic polypeptide
  source 1..296: mol_type = other DNA

SEQ ID NO: 2649 - DNA, 364 bp, synthetic construct
  misc_feature 1..364: note = Synthetic polypeptide
  source 1..364: mol_type = other DNA
atggaagctgccccgtccaggttcatgttcctcttatttctcctcacgtgtgagctggctgcagaagttgctgcagaagttgagaaatcctcagatggtcctggtgctgcccaggaacccacgtggctcacagatgtcccagctgccatggaattcattgctgccactgaggtggctgtcataggcttcttccaggatttagaaataccagcagtgcccatactccatagcatggtgcaaaaattcccaggcgtgtcatttgggatcagcactgattctgaggttctgacacactacaacatcactgggaacaccatctgcctctttcgcctggaaactacttctcctgatcctcctgctgctt

SEQ ID NO: 2650 - DNA, 1237 bp, synthetic construct
  misc_feature 1..1237: note = Synthetic polypeptide
  source 1..1237: mol_type = other DNA
atgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagcacagtggctcactaatcccagcactttgggaggccaaggcaggtggttcatttgagaccaggagtttgagaccagcttgggcaacatagcaagacctcgtctccaccaaaa

SEQ ID NO: 2651 - DNA, 192 bp, synthetic construct
  misc_feature 1..192: note = Synthetic polypeptide
  source 1..192: mol_type = other DNA
atgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacaatgtggagaa

SEQ ID NO: 2652 - DNA, 565 bp, synthetic construct; identical to SEQ ID NO: 1420
  misc_feature 1..565: note = Synthetic polypeptide
  source 1..565: mol_type = other DNA

SEQ ID NO: 2653 - DNA, 1201 bp, synthetic construct
  misc_feature 1..1201: note = Synthetic polypeptide
  source 1..1201: mol_type = other DNA
atggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacaggtcacatctggcagcctcagctctctggattcttaacagaaccaagaagcaagtaaaacaaataattgaactggcagcccaagtcaatgtcagaaaagtttataaact

SEQ ID NO: 2654 - DNA, 868 bp, synthetic construct
  misc_feature 1..868: note = Synthetic polypeptide
  source 1..868: mol_type = other DNA
atggtgtgcttccgcctcttcccggttccgggctcagggctcgttctggtctgcctagtcctgggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacaggtcacatctggcagcctcagctctctggattcttaacagaaccaagaagcaagtaaaacaaataattgaactggcagcccaagtcaatgtcagaaaagtttataaact

SEQ ID NO: 2655 - DNA, 744 bp, synthetic construct
  misc_feature 1..744: note = Synthetic polypeptide
  source 1..744: mol_type = other DNA
gcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacaggtcacatctggcagcctcagctctctggattcttaacagaaccaagaagcaagtaaaacaaataattgaactggcagcccaagtcaatgtcagaaaagtttataaact

SEQ ID NO: 2656 - DNA, 1060 bp, synthetic construct
  misc_feature 1..1060: note = Synthetic polypeptide
  source 1..1060: mol_type = other DNA
atgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacaggtcacatctggcagcctcagctctctggattcttaacagaaccaagaagcaagtaaaacaaataattgaactggcagcccaagtcaatgtcagaaaagtttataaact

SEQ ID NO: 2657 - DNA, 1111 bp, synthetic construct; identical to SEQ ID NO: 1156
  misc_feature 1..1111: note = Synthetic polypeptide
  source 1..1111: mol_type = other DNA

SEQ ID NO: 2658 - DNA, 1138 bp, synthetic construct; identical to SEQ ID NO: 1157
  misc_feature 1..1138: note = Synthetic polypeptide
  source 1..1138: mol_type = other DNA

SEQ ID NO: 2659 - DNA, 1345 bp, synthetic construct; identical to SEQ ID NO: 1158
  misc_feature 1..1345: note = Synthetic polypeptide
  source 1..1345: mol_type = other DNA

SEQ ID NO: 2660 - DNA, 1249 bp, synthetic construct; identical to SEQ ID NO: 1159
  misc_feature 1..1249: note = Synthetic polypeptide
  source 1..1249: mol_type = other DNA

SEQ ID NO: 2661 - DNA, 97 bp, synthetic construct
  misc_feature 1..97: note = Synthetic polypeptide
  source 1..97: mol_type = other DNA
atgttctctccctggaagatatcaatgtttctgtctgttcgtgaggactccgtgcccaccacggcctctttcaggctcattctctaccctccagcca

SEQ ID NO: 2662 - DNA, 686 bp, synthetic construct
  misc_feature 1..686: note = Synthetic polypeptide
  source 1..686: mol_type = other DNA
atgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccggactccgtgagaccagagtcctgtccatctggttcattgcagccacctcaggacagaacacagatcctggcacccagtagatgtgctcaataattacttgctgaattaataaa

SEQ ID NO: 2663 - DNA, 167 bp, synthetic construct
  misc_feature 1..167: note = Synthetic polypeptide
  source 1..167: mol_type = other DNA
atggccatggagatagacagcaggcctggggggctccccggcagtagctgcaacctaggtgcagcccgagaacacatgcaggcggtcacccgaaactacatcacccacccccgtgtcacttagtacatagaaggcatccatgcagtagatatgcttgaagaaaggaa

SEQ ID NO: 2664 - DNA, 361 bp, synthetic construct
  misc_feature 1..361: note = Synthetic polypeptide
  source 1..361: mol_type = other DNA
atgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaaacccatttaggggcagggcagcaatgtgccctgtggaaaatactcccctgaccag

SEQ ID NO: 2665 - DNA, 357 bp, synthetic construct
  misc_feature 1..357: note = Synthetic polypeptide
  source 1..357: mol_type = other DNA
cgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaaacccatttaggggcagggcagcaatgtgccctgtggaaaatactcccctgaccag

SEQ ID NO: 2666 - DNA, 265 bp, synthetic construct
  misc_feature 1..265: note = Synthetic polypeptide
  source 1..265: mol_type = other DNA
atggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaaacccatttaggggcagggcagcaatgtgccctgtggaaaatactcccctgaccag

SEQ ID NO: 2667 - DNA, 496 bp, synthetic construct
  misc_feature 1..496: note = Synthetic polypeptide
  source 1..496: mol_type = other DNA
atggggagcctcagcggtctgcgcctggcagcagcttcacaatagtcttgaaaaccaacagcctcacaaatcacagttactttgaaaaccagcagccttgcaggcactgaagaaggcagaatgggtttaagagttttccaaaacttccagctgcagagaattgttactatttgacttgtctgacagttcgctggaaaccccactcacagggcttatcttttttcacctgacttggagtttattcactgcaaacagtgttttccctggtgcatttgttgaaaataatcagcagcacttgtttgacataacatggagtgggtaacagctgggtcaaacaagaagctggggaatgagatgtccatcctgacatctggaaagctctgacatatttctagaatgtaatatgtgtaaggttggacacattttccaggaaaaacctgagaggtctctaagctctcacctcacatttagtctctgtccgagcacgaatggaagg

SEQ ID NO: 2668 - DNA, 1136 bp, synthetic construct
  misc_feature 1..1136: note = Synthetic polypeptide
  source 1..1136: mol_type = other DNA
atgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagca

SEQ ID NO: 2669 - DNA, 426 bp, synthetic construct
  misc_feature 1..426: note = Synthetic polypeptide
  source 1..426: mol_type = other DNA
atgttggtggaggtggccgcagccattgctggctatgtgtttagagataaggtgatgtcagagtttaataacaacttccggcagcagatggagaattacccgaaaaacaaccacactgcttcgatcctggacaggatgcaggcagatcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacctactcaggagggtgaggcaggagaatcgcttgaacccgggaggcggaggttgcagtgagccgagattgagccaccgctgggcacttgtctgggcaacagagcaagtctctgtctcaaaaaaaaaaaaaaaaaaaaaaaaagaa

SEQ ID NO: 2670 - DNA, 705 bp, synthetic construct
  misc_feature 1..705: note = Synthetic polypeptide
  source 1..705: mol_type = other DNA
atggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagatcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacctactcaggagggtgaggcaggagaatcgcttgaacccgggaggcggaggttgcagtgagccgagattgagccaccgctgggcacttgtctgggcaacagagcaagtctctgtctcaaaaaaaaaaaaaaaaaaaaaaaaagaa

SEQ ID NO: 2671 - DNA, 459 bp, synthetic construct
  misc_feature 1..459: note = Synthetic polypeptide
  source 1..459: mol_type = other DNA
atgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagatcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacctactcaggagggtgaggcaggagaatcgcttgaacccgggaggcggaggttgcagtgagccgagattgagccaccgctgggcacttgtctgggcaacagagcaagtctctgtctcaaaaaaaaaaaaaaaaaaaaaaaaagaa

SEQ ID NO: 2672 - DNA, 636 bp, synthetic construct
  misc_feature 1..636: note = Synthetic polypeptide
  source 1..636: mol_type = other DNA
atggcggtggaaggaggaatgaaatgtgtgaagttcttgctctacgtcctcctgctggccttttgcggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagatcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacctactcaggagggtgaggcaggagaatcgcttgaacccgggaggcggaggttgcagtgagccgagattgagccaccgctgggcacttgtctgggcaacagagcaagtctctgtctcaaaaaaaaaaaaaaaaaaaaaaaaagaa

SEQ ID NO: 2673 - DNA, 3378 bp, synthetic construct
  misc_feature 1..3378: note = Synthetic polypeptide
  source 1..3378: mol_type = other DNA
atgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaaggagacttctttatttaacctgtggaaagcatcatgactgcctgaaaggagagacaaagaggggagaagggactaccttccccagccctggaaactctgctcggtaactcaggcaaaggagccaaatcacaatagctaatttgtgccacaggtcccttgggcacgaacctctagccagacttctgtcactgttgggataatcattttcagactctcccatttggggcagacagtgccctgaccatttgctagaggcaaggcaaacctgggcttaagatatcacctatagccaagaaaaaggcaatagtagtgaagatttgctaagaaaatatatccaataaaaaccaagacaagttgaatagaggaagctggaataaataaccaatccttcaatgcaaagacatagacatatacccacaagaaacaacactgaatagggaaatgtgacctctgcaaaaggacaaaggaaaaatccagtgaccgaccctaacaagacagtcatttgtgagctctctgaccaaaaattcaaaagagcagtttcaaggaaattcagtgatctctaaaataatacagaaaagcaattcagaaaattgctggagaaatttaacaaagagaatttgttaaatttttaaagttaactttaaaaactcaaacaaattttggaactgagaaatacgtttgctgagctgaacaactaattagaggctctcaacatccaaatggaacaaccagagggaagaatcagtgagctcaaagaccagctatttgaaaatacagtcagaggagaaaaaagaaaaaagaaagaaaaagaacaaaaactgcctacaagatatagaaaattacctcaaaaaccaaatctaagaattcttgatgttcaaaagggagctgagcaaaggcagagggcagaaagaaaaaatacaaaattttccagagcttgagaaagatataaatctccagtacgggaaggtctgataatacccaagagattcaacccaaataagactaccccaaggtatgtaataaccaaactctcaaaggtcaaggacaaagagaggatctcaaaagcagcaagagaaaagaagcaaataacatataaaggacctccaattcttctggtaacagacttttcaatgaaaaaccatacagacaggagggagtggaacaacatattcaaagtgctcaaagaaaaaaaaagccatctaagaacactgtatccagcaaaattaccctttgaatatgaaggagaaatagtctttcccaaacaactaaagttcagagaatccacccccatcagacccatcatcttacagtaaatggtaaagggggttcttcaatctgaaaggaaaaaaaacaacattaacatacaaaaagaaaactttcctttatttacccactggtaaaattaagtacatgaatacttaattttaagaattctctagaatactgagaatactctgttacaataattgtggtgtgtaagcactcataactctagtatgaagcccaatcaaaaacaatagctatagcaacctgttaagagatgtaatataaaaatatgtaaattgagacaactaagtcaaaatgtggcattttgtgtgtatgtgtgtttgtctttgtttctattcctttctttgtaatccaaaatattatctctttaaaataactttttatatctatacaatgttttttgtaaccctcctggtaaccacagcccaaaaacctacaatatattcactaaaaataaaaaacaacaaattaaaacgtactatcagagaaagtaaccaccaaagaagacagtaggaaagaaaagaaaggagtcttaaaactatcagaaaataggcaacaaaatggcagtagtaagtctttacttaatagtaacactgaatgtaaatggtctcaattttcaaataaaaagcttagaatggctgaaggaattaaaaaagcaagaccaaactatatgctgccttcaagaaactctcttcacttataaagacacacagactgaaagagaagcagtgaaaaatgatattccatgcaactggaaaccaaaaatagcaggagtagctatacttatataaaatagactacaaatctaagattgtaaaaagagacaaagatgatcatgaaaggggtcaattaagcaagagggtataacaattataaatatctatgcacacaacaccagaactcctaggtatataaagcaaacattaatatctaaaagggtagactgcaatataataatagtagcggactttaacaccccactctcagtaatggacagatcatccagacagaaaatcaacaaagagcataaactacacactagaataggcctaactaacatttacagaacatttcacccatatgatagctaacttcatactgtgtattttgtgctgcagaatacatattcttttcatcagcacatggaatattcttcagaatagaccatatcttaggccacaaaatatatctgaaaaaattttcaaaatagaaatcatatcaagtagcttttctgaccacaatgaaataaaactagaaatcagtaacaagaggaactttggaaaatgcacaaacacatggaaattatacaacatggtcttaaatggccaatgaaaaagttaagaaggaacttttaaaatttcttcaaacaaataaatgaaaatggaaataaaacataccaaaatctatggggtatggcaagagcccagtaccaagagggaagtttatagcaataaatgcctgtatcaaaaaagtagaaagacttcaaataaaataacttaatgttgcacctcaaggcactagaaaagaaagaacaaaccccaaactggtagaaggaaagaaacaataaagatcagagcagaaatacatgaaactaagactaaaaaaaaaaaaaaaaaaaaaacaaaaaaaaaacagaagataaaacctttcgctagattaagtaggaagagcacaaacctgaataaataaaatcagaaatgaaaaaggagacataataactgagacctcagaaatacaaagaatcattagcaagtattatgaacaaatatatgccaacaaattggaaaacttagaagaaatggatacattcctggacacatacaacctatcaagattgaatca

SEQ ID NO: 2674 - DNA, 3570 bp, synthetic construct
  misc_feature 1..3570: note = Synthetic polypeptide
  source 1..3570: mol_type = other DNA
atgttttcagcattgaaatatcatgcaatagactatttatatgagaatgtggttagaaagaagttttacagagatgctttattgcttcgaatcccttcatgtttatatcaagatgaaagttaccatgtagcagttactgataataaatttaggaggccatggacgagagtctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaaggagacttctttatttaacctgtggaaagcatcatgactgcctgaaaggagagacaaagaggggagaagggactaccttccccagccctggaaactctgctcggtaactcaggcaaaggagccaaatcacaatagctaatttgtgccacaggtcccttgggcacgaacctctagccagacttctgtcactgttgggataatcattttcagactctcccatttggggcagacagtgccctgaccatttgctagaggcaaggcaaacctgggcttaagatatcacctatagccaagaaaaaggcaatagtagtgaagatttgctaagaaaatatatccaataaaaaccaagacaagttgaatagaggaagctggaataaataaccaatccttcaatgcaaagacatagacatatacccacaagaaacaacactgaatagggaaatgtgacctctgcaaaaggacaaaggaaaaatccagtgaccgaccctaacaagacagtcatttgtgagctctctgaccaaaaattcaaaagagcagtttcaaggaaattcagtgatctctaaaataatacagaaaagcaattcagaaaattgctggagaaatttaacaaagagaatttgttaaatttttaaagttaactttaaaaactcaaacaaattttggaactgagaaatacgtttgctgagctgaacaactaattagaggctctcaacatccaaatggaacaaccagagggaagaatcagtgagctcaaagaccagctatttgaaaatacagtcagaggagaaaaaagaaaaaagaaagaaaaagaacaaaaactgcctacaagatatagaaaattacctcaaaaaccaaatctaagaattcttgatgttcaaaagggagctgagcaaaggcagagggcagaaagaaaaaatacaaaattttccagagcttgagaaagatataaatctccagtacgggaaggtctgataatacccaagagattcaacccaaataagactaccccaaggtatgtaataaccaaactctcaaaggtcaaggacaaagagaggatctcaaaagcagcaagagaaaagaagcaaataacatataaaggacctccaattcttctggtaacagacttttcaatgaaaaaccatacagacaggagggagtggaacaacatattcaaagtgctcaaagaaaaaaaaagccatctaagaacactgtatccagcaaaattaccctttgaatatgaaggagaaatagtctttcccaaacaactaaagttcagagaatccacccccatcagacccatcatcttacagtaaatggtaaagggggttcttcaatctgaaaggaaaaaaaacaacattaacatacaaaaagaaaactttcctttatttacccactggtaaaattaagtacatgaatacttaattttaagaattctctagaatactgagaatactctgttacaataattgtggtgtgtaagcactcataactctagtatgaagcccaatcaaaaacaatagctatagcaacctgttaagagatgtaatataaaaatatgtaaattgagacaactaagtcaaaatgtggcattttgtgtgtatgtgtgtttgtctttgtttctattcctttctttgtaatccaaaatattatctctttaaaataactttttatatctatacaatgttttttgtaaccctcctggtaaccacagcccaaaaacctacaatatattcactaaaaataaaaaacaacaaattaaaacgtactatcagagaaagtaaccaccaaagaagacagtaggaaagaaaagaaaggagtcttaaaactatcagaaaataggcaacaaaatggcagtagtaagtctttacttaatagtaacactgaatgtaaatggtctcaattttcaaataaaaagcttagaatggctgaaggaattaaaaaagcaagaccaaactatatgctgccttcaagaaactctcttcacttataaagacacacagactgaaagagaagcagtgaaaaatgatattccatgcaactggaaaccaaaaatagcaggagtagctatacttatataaaatagactacaaatctaagattgtaaaaagagacaaagatgatcatgaaaggggtcaattaagcaagagggtataacaattataaatatctatgcacacaacaccagaactcctaggtatataaagcaaacattaatatctaaaagggtagactgcaatataataatagtagcggactttaacaccccactctcagtaatggacagatcatccagacagaaaatcaacaaagagcataaactacacactagaataggcctaactaacatttacagaacatttcacccatatgatagctaacttcatactgtgtattttgtgctgcagaatacatattcttttcatcagcacatggaatattcttcagaatagaccatatcttaggccacaaaatatatctgaaaaaattttcaaaatagaaatcatatcaagtagcttttctgaccacaatgaaataaaactagaaatcagtaacaagaggaactttggaaaatgcacaaacacatggaaattatacaacatggtcttaaatggccaatgaaaaagttaagaaggaacttttaaaatttcttcaaacaaataaatgaaaatggaaataaaacataccaaaatctatggggtatggcaagagcccagtaccaagagggaagtttatagcaataaatgcctgtatcaaaaaagtagaaagacttcaaataaaataacttaatgttgcacctcaaggcactagaaaagaaagaacaaaccccaaactggtagaaggaaagaaacaataaagatcagagcagaaatacatgaaactaagactaaaaaaaaaaaaaaaaaaaaaacaaaaaaaaaacagaagataaaacctttcgctagattaagtaggaagagcacaaacctgaataaataaaatcagaaatgaaaaaggagacataataactgagacctcagaaatacaaagaatcattagcaagtattatgaacaaatatatgccaacaaattggaaaacttagaagaaatggatacattcctggacacatacaacctatcaagattgaatca

SEQ ID NO: 2675 - DNA, 1165 bp, synthetic construct
  misc_feature 1..1165: note = Synthetic polypeptide
  source 1..1165: mol_type = other DNA
atggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagacagggtcctggcctccctgagctcccatttcttcatggaggggtgattgtgtctgcctgcctcataggatcatagtgagtgttaagtgagtgatgatattaaag

SEQ ID NO: 2676 - DNA, 940 bp, synthetic construct
  misc_feature 1..940: note = Synthetic polypeptide
  source 1..940: mol_type = other DNA
acgccccgcctcgccccggcggcagagaggagactatggaacgtcagactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagacagggtcctggcctccctgagctcccatttcttcatggaggggtgattgtgtctgcctgcctcataggatcatagtgagtgttaagtgagtgatgatattaaag

SEQ ID NO: 2677 - DNA, 2937 bp, synthetic construct
  misc_feature 1..2937: note = Synthetic polypeptide
  source 1..2937: mol_type = other DNA
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaatgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttggatacagccctctgcggactgggctggggctgtttggccattataccctcggcttctaggacagtggctgtgacacagcagatgctcaaagaatatct

SEQ ID NO: 2678 - DNA, 2655 bp, synthetic construct
  misc_feature 1..2655: note = Synthetic polypeptide
  source 1..2655: mol_type = other DNA
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttggatacagccctctgcggactgggctggggctgtttggccattataccctcggcttctaggacagtggctgtgacacagcagatgctcaaagaatatct

SEQ ID NO: 2679 - DNA, 314 bp, synthetic construct; identical to SEQ ID NO: 998
  misc_feature 1..314: note = Synthetic polypeptide
  source 1..314: mol_type = other DNA

SEQ ID NO: 2680 - DNA, 228 bp, synthetic construct
  misc_feature 1..228: note = Synthetic polypeptide
  source 1..228: mol_type = other DNA
atgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttcccagaccctccctgctattctctctgcttccgctcttgcctcgttacattccatacttcacacagcag

SEQ ID NO: 2681 - DNA, 914 bp, synthetic construct; identical to SEQ ID NO: 931
  misc_feature 1..914: note = Synthetic polypeptide
  source 1..914: mol_type = other DNA

SEQ ID NO: 2682 - DNA, 251 bp, synthetic construct; identical to SEQ ID NO: 932
  misc_feature 1..251: note = Synthetic polypeptide
  source 1..251: mol_type = other DNA

SEQ ID NO: 2683 - DNA, 1016 bp, synthetic construct; identical to SEQ ID NO: 933
  misc_feature 1..1016: note = Synthetic polypeptide
  source 1..1016: mol_type = other DNA

SEQ ID NO: 2684 - DNA, 834 bp, synthetic construct
  misc_feature 1..834: note = Synthetic polypeptide
  source 1..834: mol_type = other DNA
atgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgaggtggcacagttcacctggtttgtcgagatcaagccccagcagaagatgccaggggtgagatcatccgggagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgcagaagggacttggcagctgcagttcagttcaaggccttgggatgagaagcgtgtcctggagtatccaggtgggcttggtggagtcccaagggtcctcatgggagggaaggaggagggtgcgagtcagaggagaagtgactatggaagcagagggtggagacgtggctgtgagccaaggagtgctgccagcctctagaagttgaaggcaaggaatggagtctcctctgagaccggcagaggggacgcagctccgctgacacttggattttagcccatgagccccacctcagacttctgggctccagaaccataggagaatacat

SEQ ID NO: 2685 - DNA, 687 bp, synthetic construct
  misc_feature 1..687: note = Synthetic polypeptide
  source 1..687: mol_type = other DNA
atgaatctgcatgtaaagactttgtccctcatgacttggaggtccagattcctggaagagtctttttggtcactggaggaaacagcggcattggcaaagcaactgcccttgaaatcgccaagcgagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgcagaagggacttggcagctgcagttcagttcaaggccttgggatgagaagcgtgtcctggagtatccaggtgggcttggtggagtcccaagggtcctcatgggagggaaggaggagggtgcgagtcagaggagaagtgactatggaagcagagggtggagacgtggctgtgagccaaggagtgctgccagcctctagaagttgaaggcaaggaatggagtctcctctgagaccggcagaggggacgcagctccgctgacacttggattttagcccatgagccccacctcagacttctgggctccagaaccataggagaatacat

SEQ ID NO: 2686 - DNA, 3488 bp, synthetic construct
  misc_feature 1..3488: note = Synthetic polypeptide
  source 1..3488: mol_type = other DNA
atgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgaaaccatatcttgatgaatc

SEQ ID NO: 2687 - DNA, 3305 bp, synthetic construct
  misc_feature 1..3305: note = Synthetic polypeptide
  source 1..3305: mol_type = other DNA
atgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgaaaccatatcttgatgaatc

SEQ ID NO: 2688 - DNA, 3398 bp, synthetic construct
  misc_feature 1..3398: note = Synthetic polypeptide
  source 1..3398: mol_type = other DNA
atgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgaaaccatatcttgatgaatc

SEQ ID NO: 2689 - DNA, 313 bp, synthetic construct
  misc_feature 1..313: note = Synthetic polypeptide
  source 1..313: mol_type = other DNA
taaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgaaaccatatcttgatgaatc

SEQ ID NO: 2690 - DNA, 528 bp, synthetic construct; identical to SEQ ID NO: 1280
  misc_feature 1..528: note = Synthetic polypeptide
  source 1..528: mol_type = other DNA

SEQ ID NO: 2691 - DNA, 438 bp, synthetic construct; identical to SEQ ID NO: 1281
  misc_feature 1..438: note = Synthetic polypeptide
  source 1..438: mol_type = other DNA

SEQ ID NO: 2692 - DNA, 1380 bp, synthetic construct
  misc_feature 1..1380: note = Synthetic polypeptide
  source 1..1380: mol_type = other DNA
atgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaacatcccaaaagtcaaccaaaggaaaacagatgaacaattgttgacttgccattcagtggaacactgccagcaat

SEQ ID NO: 2693 - DNA, 1230 bp, synthetic construct
  misc_feature 1..1230: note = Synthetic polypeptide
  source 1..1230: mol_type = other DNA
atgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaacatcccaaaagtcaaccaaaggaaaacagatgaacaattgttgacttgccattcagtggaacactgccagcaat

SEQ ID NO: 2694 - DNA, 397 bp, synthetic construct
  misc_feature 1..397: note = Synthetic polypeptide
  source 1..397: mol_type = other DNA
atgctcgaaggtgcggagctgtacttcaacgtggaccatggctacctggagggcctggttcgaggatgcaaggccagcctcctgacccagcaagactatatcaacctggtccagtgtgagaccctagaaggtctacaggatgctttccaagggttatggagacaggagtgattataagatgaccactttccagatcctgagtgcctatatgtatatatactaaaactacctaagagtacttgaagtcagaacactgtgctgggttccccttatcacctccttatcacaactgttctttttccaccatccttttacaccatactatgatgtatagccctgaggtataaaaagctttagggcactaaacaaaccacaggaccatttgaagtgttagtgt

SEQ ID NO: 2695 - DNA, 561 bp, synthetic construct
  misc_feature 1..561: note = Synthetic polypeptide
  source 1..561: mol_type = other DNA
atgctcgaaggtgcggagctgtacttcaacgtggaccatggctacctggagggcctggttcgaggatgcaaggccagcctcctgacccagcaagactatatcaacctggtccagtgtgagaccctagaagacctgaaaattcatctccagactactgattatggtaactttttggctaatcacacaaatcctcttactgtttccaaaattgacactgagatgaggaaaagactatgtggagaatttgagtatttccggaatcattccctggagcccctcagcacatttctcacctatatgacgatgctttccaagggttatggagacaggagtgattataagatgaccactttccagatcctgagtgcctatatgtatatatactaaaactacctaagagtacttgaagtcagaacactgtgctgggttccccttatcacctccttatcacaactgttctttttccaccatccttttacaccatactatgatgtatagccctgaggtataaaaagctttagggcactaaacaaaccacaggaccatttgaagtgttagtgt

SEQ ID NO: 2696 - DNA, 661 bp, synthetic construct
  misc_feature 1..661: note = Synthetic polypeptide
  source 1..661: mol_type = other DNA
atggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggcgtggtggcacatgccagctacttgggaggctgaggcagaagaatcgcttgaatccaggaggcggaggttgccgtgagccgagatcgcgccattgcactccagcctgggcaacaagagcgaaactccatctcaacaaaaaaagaaaagaaaagaaaaaaaa

SEQ ID NO: 2697 - DNA, 786 bp, synthetic construct
  misc_feature 1..786: note = Synthetic polypeptide
  source 1..786: mol_type = other DNA
atggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattacacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggcgtggtggcacatgccagctacttgggaggctgaggcagaagaatcgcttgaatccaggaggcggaggttgccgtgagccgagatcgcgccattgcactccagcctgggcaacaagagcgaaactccatctcaacaaaaaaagaaaagaaaagaaaaaaaa

SEQ ID NO: 2698 - DNA, 757 bp, synthetic construct
  misc_feature 1..757: note = Synthetic polypeptide
  source 1..757: mol_type = other DNA
atggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccagcacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggcgtggtggcacatgccagctacttgggaggctgaggcagaagaatcgcttgaatccaggaggcggaggttgccgtgagccgagatcgcgccattgcactccagcctgggcaacaagagcgaaactccatctcaacaaaaaaagaaaagaaaagaaaaaaaa

SEQ ID NO: 2699 - DNA, 432 bp, synthetic construct
  misc_feature 1..432: note = Synthetic polypeptide
  source 1..432: mol_type = other DNA
tgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggcgtggtggcacatgccagctacttgggaggctgaggcagaagaatcgcttgaatccaggaggcggaggttgccgtgagccgagatcgcgccattgcactccagcctgggcaacaagagcgaaactccatctcaacaaaaaaagaaaagaaaagaaaaaaaa

SEQ ID NO: 2700 - DNA, 385 bp, synthetic construct
  misc_feature 1..385: note = Synthetic polypeptide
  source 1..385: mol_type = other DNA
caagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggcgtggtggcacatgccagctacttgggaggctgaggcagaagaatcgcttgaatccaggaggcggaggttgccgtgagccgagatcgcgccattgcactccagcctgggcaacaagagcgaaactccatctcaacaaaaaaagaaaagaaaagaaaaaaaa

SEQ ID NO: 2701 - DNA, 37 bp, synthetic construct; identical to SEQ ID NO: 1671
  misc_feature 1..37: note = Synthetic polypeptide
  source 1..37: mol_type = other DNA

SEQ ID NO: 2702 - DNA, 1420 bp, synthetic construct; identical to SEQ ID NO: 924
  misc_feature 1..1420: note = Synthetic polypeptide
  source 1..1420: mol_type = other DNA

SEQ ID NO: 2703 - DNA, 1336 bp, synthetic construct; identical to SEQ ID NO: 925
  misc_feature 1..1336: note = Synthetic polypeptide
  source 1..1336: mol_type = other DNA

SEQ ID NO: 2704 - DNA, 1069 bp, synthetic construct; identical to SEQ ID NO: 926
  misc_feature 1..1069: note = Synthetic polypeptide
  source 1..1069: mol_type = other DNA

SEQ ID NO: 2705 - DNA, 1345 bp, synthetic construct; identical to SEQ ID NO: 927
  misc_feature 1..1345: note = Synthetic polypeptide
  source 1..1345: mol_type = other DNA

SEQ ID NO: 2706 - DNA, 941 bp, synthetic construct
  misc_feature 1..941: note = Synthetic polypeptide
  source 1..941: mol_type = other DNA
atgaacaaaacaaaccaagtgtatgcagcaaatgaggatcataactctcagtttattgatgattattcatcctcagatgagagtttatccgtcagccacttcagtttctctaaacagagccacagaccaagaactataagagacagaactagtttttcttcaaaattgcctagccataataagaaaaatagcacttttattccaagaaaaccaatgaaatgttcaaatgagaaagttgttaatcaagagcagtcgtatgaatcaatggataaatttttagatggcgttcaggaagtggcttatattcactcaaaccagaatgtaattggatcgagcaaagctgaaaatcacatgagccgatgggcagcacatgacgtatttgagttgaagcagttttctcagctgcctgctaacatagctgtttgcagttctaagacatataaagaaaaagtggatgcagatacattgccacacacaaagaaaggccagcaaccgagtgaaggcagcatttcacttcctctttacatttcaaatcctgtaaaccagaagaagaaaaaagtctaccatacaaaccagaccaccttcataattggagaaacaccaaaaggaatccgcaggtcacaaagctccttctcaaacttgttctggaggaagccagcagccatgtcataaggaagctcaagcagccatatggagagcccacatgggaagggacagaggcctcctgcccacagccgtggagatgaaccaccttggagacagctcccccagccccaacacacgcagatgatcatggtcctggctgacatcttcactgcaacctcacgagagacccaagccacaacttcccagctgagcccacagatgtggtatgagatgatgtgcttgtcggcttaagctgttatggctttggggtgattcgttagcagcactggataact

SEQ ID NO: 2707 - DNA, 913 bp, synthetic construct
  misc_feature 1..913: note = Synthetic polypeptide
  source 1..913: mol_type = other DNA
caaatgaggatcataactctcagtttattgatgattattcatcctcagatgagagtttatccgtcagccacttcagtttctctaaacagagccacagaccaagaactataagagacagaactagtttttcttcaaaattgcctagccataataagaaaaatagcacttttattccaagaaaaccaatgaaatgttcaaatgagaaagttgttaatcaagagcagtcgtatgaatcaatggataaatttttagatggcgttcaggaagtggcttatattcactcaaaccagaatgtaattggatcgagcaaagctgaaaatcacatgagccgatgggcagcacatgacgtatttgagttgaagcagttttctcagctgcctgctaacatagctgtttgcagttctaagacatataaagaaaaagtggatgcagatacattgccacacacaaagaaaggccagcaaccgagtgaaggcagcatttcacttcctctttacatttcaaatcctgtaaaccagaagaagaaaaaagtctaccatacaaaccagaccaccttcataattggagaaacaccaaaaggaatccgcaggtcacaaagctccttctcaaacttgttctggaggaagccagcagccatgtcataaggaagctcaagcagccatatggagagcccacatgggaagggacagaggcctcctgcccacagccgtggagatgaaccaccttggagacagctcccccagccccaacacacgcagatgatcatggtcctggctgacatcttcactgcaacctcacgagagacccaagccacaacttcccagctgagcccacagatgtggtatgagatgatgtgcttgtcggcttaagctgttatggctttggggtgattcgttagcagcactggataact

SEQ ID NO: 2708 - DNA, 3947 bp, synthetic construct
  misc_feature 1..3947: note = Synthetic polypeptide
  source 1..3947: mol_type = other DNA
atgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgctgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgacgacgtcgtgcaggccatcaaagaccacgcctttgttacctcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgccgatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaagcagcagggcgatcctccggtggagtttgccacagacagggtggaggagctctttgagtggtttcagagcatccgagagatcacctggaagattgacaccaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaatgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatgacaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagctccagctgtaccaggagaaatgcaacaagagggttgattcggctgatctggctggctaggtgggtgtccccttcctacctcaccgctccatgtgcgtccctcccgaagctgcgcgctccgtcgaagaggacgaccaaccccgatagaggaggaccggtcttcggtcaagggtatacgagtagctgcgctcccctgctggaacctccaaacaagctctcaagat

SEQ ID NO: 2709 - DNA, 609 bp, synthetic construct; identical to SEQ ID NO: 249
  misc_feature 1..609: note = Synthetic polypeptide
  source 1..609: mol_type = other DNA

SEQ ID NO: 2710 - DNA, 738 bp, synthetic construct; identical to SEQ ID NO: 250
  misc_feature 1..738: note = Synthetic polypeptide
  source 1..738: mol_type = other DNA

SEQ ID NO: 2711 - DNA, 537 bp, synthetic construct; identical to SEQ ID NO: 251
  misc_feature 1..537: note = Synthetic polypeptide
  source 1..537: mol_type = other DNA

SEQ ID NO: 2712 - DNA, 684 bp, synthetic construct; identical to SEQ ID NO: 253
  misc_feature 1..684: note = Synthetic polypeptide
  source 1..684: mol_type = other DNA

SEQ ID NO: 2713 - DNA, 285 bp, synthetic construct; identical to SEQ ID NO: 255
  misc_feature 1..285: note = Synthetic polypeptide
  source 1..285: mol_type = other DNA

SEQ ID NO: 2714 - DNA, 552 bp, synthetic construct; identical to SEQ ID NO: 254
  misc_feature 1..552: note = Synthetic polypeptide
  source 1..552: mol_type = other DNA

SEQ ID NO: 2715 - DNA, 1871 bp, synthetic construct
  misc_feature 1..1871: note = Synthetic polypeptide
  source 1..1871: mol_type = other DNA
atggcagaggctggggatgctgcgctatcggtggccgagtggctgcgggcattgcacctggagcagtacacggggctctttgagcagcatggcctggtgtgggccactgagtgccaaggcctcagcgacacccgcctgatggacatgggcatgctactccctggtcaccgccgccgcatcctggctggcctgctccgtgcccatacctcaccggcccctgcaccccgccccaccccacggcctgtgcccatgaagcgccacatcttccgctcaccacctgtgcctgccactccacccgagccgctgcccaccactacagaggatgaggggctccccgctgccccacccatcccgccccggaggagctgccttccgcccacctgcttcaccaccccatccacagctgccccagaccctgtgctgcccccgctgcctgctaagcggcatttggcagagctgagcgttccacccgtgccgccccgcaccggacccccccgcctgctggtgagcctgcccactaaggaggaggagtcattgctgccatcattatcatcccctccccagccacagtctgaggagcccctgtccaccctcccccaggggcctccccagcctccctctccacctccctgccccccggagatacctccaaagccggtacgcctgttcccagagttcgatgactctgactacgatgaggtcccagaggaggggccgggggccccagccagagtgatgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagcaccccatacaggacctgacaaggaggcaaggtggggggcctaggaaatggctgtggaatga

SEQ ID NO: 2716 - DNA, 1151 bp, synthetic construct
  misc_feature 1..1151: note = Synthetic polypeptide
  source 1..1151: mol_type = other DNA
atgacgctgagtgggtctcgggggcaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagcaccccatacaggacctgacaaggaggcaaggtggggggcctaggaaatggctgtggaatga

SEQ ID NO: 2717 - DNA, 1136 bp, synthetic construct
  misc_feature 1..1136: note = Synthetic polypeptide
  source 1..1136: mol_type = other DNA
atgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagcaccccatacaggacctgacaaggaggcaaggtggggggcctaggaaatggctgtggaatga

SEQ ID NO: 2718 - DNA, 2264 bp, synthetic construct
  misc_feature 1..2264: note = Synthetic polypeptide
  source 1..2264: mol_type = other DNA
atgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgcaacttctgctgatcgcttttatcgaatagacagatctcaggaacatttgcactttgtgatggagatttcccaagatgagatttttattctggacccagatatggtggtgtcacagccggcggggacacctccgggcatgcctgacctggtggtggaacaagcctcggggtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaaggtctccttcctgccacctagtgaagaagttgcctttcttccctttgccttccagcatgattgtaaagcttcctgaggcctccccagccatgctgaactgtgagtcaattaaacctcattataaattatccagtctcaagtatgtctttattaacagcatgagaaatgactaataca

SEQ ID NO: 2719 - DNA, 3257 bp, synthetic construct
  misc_feature 1..3257: note = Synthetic polypeptide
  source 1..3257: mol_type = other DNA
atggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaaggtctccttcctgccacctagtgaagaagttgcctttcttccctttgccttccagcatgattgtaaagcttcctgaggcctccccagccatgctgaactgtgagtcaattaaacctcattataaattatccagtctcaagtatgtctttattaacagcatgagaaatgactaataca

SEQ ID NO: 2720 - DNA, 3296 bp, synthetic construct
  misc_feature 1..3296: note = Synthetic polypeptide
  source 1..3296: mol_type = other DNA
atggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatattcatcaggtgcaaactgcggacctgcggcgagtgtctgctccccccggctccttcaccattccccagtctgtcccagatcgtctgaggatccgggtgaacaaaatcagtttacaagactatgaaggattccactatgacaaggagaaactccgagaagcttcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgcaacttctgctgatcgcttttatcgaatagacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaaggtctccttcctgccacctagtgaagaagttgcctttcttccctttgccttccagcatgattgtaaagcttcctgaggcctccccagccatgctgaactgtgagtcaattaaacctcattataaattatccagtctcaagtatgtctttattaacagcatgagaaatgactaataca

SEQ ID NO: 2721 - DNA, 3203 bp, synthetic construct
  misc_feature 1..3203: note = Synthetic polypeptide
  source 1..3203: mol_type = other DNA
atggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaaggtctccttcctgccacctagtgaagaagttgcctttcttccctttgccttccagcatgattgtaaagcttcctgaggcctccccagccatgctgaactgtgagtcaattaaacctcattataaattatccagtctcaagtatgtctttattaacagcatgagaaatgactaataca

SEQ ID NO: 2722 - DNA, 1236 bp, synthetic construct; identical to SEQ ID NO: 980
  misc_feature 1..1236: note = Synthetic polypeptide
  source 1..1236: mol_type = other DNA

SEQ ID NO: 2723 - DNA, 523 bp, synthetic construct
  misc_feature 1..523: note = Synthetic polypeptide
  source 1..523: mol_type = other DNA
atgtccacgtggaaagcaagactcaccaaaagactgaagtctccctctagaagcatgcatccatttccgtgctcagctctgctcgcctgttttgggaatacgagggagagtgcttccttcaatcagtccggcgtggctgatactcattccaccgtccgtgtgcagcctgtggccaaagcaggcagacagccaagacacccaagcgcagaaggagctccagagaaaaggcaagattcgagcacccatgcagagagaaatggcagtgcgaatcggaattcaagtcaccgcactgcggcccagcccgcggagacgcctgaagatgtgcccgggtccctggatgatggggcggactgtgaagcagtggtgtttcacgcttccatccccagaccatcaattattgacacgcccaaggaagaagaatttcgagaagaacctaaatgcctcgagctggagcagaaaatgacatcaggtcctgacatattgcctggcccccgttggatgcatggatgtttattgaatgaat

SEQ ID NO: 2724 - DNA, 675 bp, synthetic construct
  misc_feature 1..675: note = Synthetic polypeptide
  source 1..675: mol_type = other DNA
atgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggaagatactggagatgtgttccaccaaaataagcgaataaatcaagaaagagggaaacatgcgattcggaaagcaggagaggaaagaaggtaagccccaggctaacagtcaagcaggaggcctcgagagcagccagaacactaggcaggaagatggaggttgggggatgaggaagaggatgggaactcacagattatctga

SEQ ID NO: 2725 - DNA, 837 bp, synthetic construct
  misc_feature 1..837: note = Synthetic polypeptide
  source 1..837: mol_type = other DNA
atgctgcatctgtcagcagaggaagccattggctgcgtgagggtcagaaggagcttcatagatgagctggcatttgggagagggcattctacagggacgggcaagcagaagcgaagggatcgagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggaagatactggagatgtgttccaccaaaataagcgaataaatcaagaaagagggaaacatgcgattcggaaagcaggagaggaaagaaggtaagccccaggctaacagtcaagcaggaggcctcgagagcagccagaacactaggcaggaagatggaggttgggggatgaggaagaggatgggaactcacagattatctga

SEQ ID NO: 2726 - DNA, 980 bp, synthetic construct
  misc_feature 1..980: note = Synthetic polypeptide
  source 1..980: mol_type = other DNA
atgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaatgctaagctccatgaagacagcaggtc

SEQ ID NO: 2727 - DNA, 1347 bp, synthetic construct
  misc_feature 1..1347: note = Synthetic polypeptide
  source 1..1347: mol_type = other DNA
atggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggcactttgggaggccgaggcgggtggatcacctgaggtcaggagttcaagaccagcctgggcaacatggagaaaccctgtctctacaaaaatacaaaaattagccaggtatgatgtcaggtgcctgtaaccccagctactcaggagtctgaggtgggagaattgcttgaacccgggaggcagaggttgcagtgagccgagatcgccccattgcactccagcctgagcaacacagcaagactctgtttcaaaaaaaaaaaaaaaaa

SEQ ID NO: 2728 - DNA, 1113 bp, synthetic construct
  misc_feature 1..1113: note = Synthetic polypeptide
  source 1..1113: mol_type = other DNA
atgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggcactttgggaggccgaggcgggtggatcacctgaggtcaggagttcaagaccagcctgggcaacatggagaaaccctgtctctacaaaaatacaaaaattagccaggtatgatgtcaggtgcctgtaaccccagctactcaggagtctgaggtgggagaattgcttgaacccgggaggcagaggttgcagtgagccgagatcgccccattgcactccagcctgagcaacacagcaagactctgtttcaaaaaaaaaaaaaaaaa

SEQ ID NO: 2729 - DNA, 322 bp, synthetic construct
  misc_feature 1..322: note = Synthetic polypeptide
  source 1..322: mol_type = other DNA
agtggatttcttcttagtcaggaaaatggatggtgctggaggccattatcctagaaaactaacgcaggaacagaaaaccaaataccacatgttctcacttataagtagaagacaaaggatgagcattcatggacacaaggaggggaacaacagacactggatcttacttgagagtgaagggtgggaggagggaaagagtcagaaaaaaaaaactattggggactaggcttagtacctgggtgatgaaatatctgtacaacaaactcccattacatgagtttacctatataccacaactgcacatgtgcctctaagcctaaaa

SEQ ID NO: 2730 - DNA, 465 bp, synthetic construct
  misc_feature 1..465: note = Synthetic polypeptide
  source 1..465: mol_type = other DNA
tgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaaaatggatggtgctggaggccattatcctagaaaactaacgcaggaacagaaaaccaaataccacatgttctcacttataagtagaagacaaaggatgagcattcatggacacaaggaggggaacaacagacactggatcttacttgagagtgaagggtgggaggagggaaagagtcagaaaaaaaaaactattggggactaggcttagtacctgggtgatgaaatatctgtacaacaaactcccattacatgagtttacctatataccacaactgcacatgtgcctctaagcctaaaa

SEQ ID NO: 2731 - DNA, 1663 bp, synthetic construct
  misc_feature 1..1663: note = Synthetic polypeptide
  source 1..1663: mol_type = other DNA
atggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggctcctgtgtatgactggtctcctcaaatccaaggcatcatctttggtgctgttggctatggtggcatactgacaatggctcccagtggatacctggctggaagagtaggaacaaagcgagtggttggcatttctttgtttgcaacttcatttctcactctatgcatccctctggccactgactttggaatagtcttgctcattgtaactcgaatagtccagggcctaagccagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaaaatggatggtgctggaggccattatcctagaaaactaacgcaggaacagaaaaccaaataccacatgttctcacttataagtagaagacaaaggatgagcattcatggacacaaggaggggaacaacagacactggatcttacttgagagtgaagggtgggaggagggaaagagtcagaaaaaaaaaactattggggactaggcttagtacctgggtgatgaaatatctgtacaacaaactcccattacatgagtttacctatataccacaactgcacatgtgcctctaagcctaaaa

SEQ ID NO: 2732 - DNA, 1429 bp, synthetic construct
  misc_feature 1..1429: note = Synthetic polypeptide
  source 1..1429: mol_type = other DNA
atggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaaaatggatggtgctggaggccattatcctagaaaactaacgcaggaacagaaaaccaaataccacatgttctcacttataagtagaagacaaaggatgagcattcatggacacaaggaggggaacaacagacactggatcttacttgagagtgaagggtgggaggagggaaagagtcagaaaaaaaaaactattggggactaggcttagtacctgggtgatgaaatatctgtacaacaaactcccattacatgagtttacctatataccacaactgcacatgtgcctctaagcctaaaa

SEQ ID NO: 2733 - DNA, 166 bp, synthetic construct
  misc_feature 1..166: note = Synthetic polypeptide
  source 1..166: mol_type = other DNA
caagcagcacatgagcagaaccaggtgctcaacaccaacagccggtacctgcatgacaacatcgtggactatgcgcagaggctgtcagagaccctgccggagcagctctgtgtgttctatttcctgaattctgggatcattgctggagcttagtgaggtaatatgt

SEQ ID NO: 2734 - DNA, 370 bp, synthetic construct
  misc_feature 1..370: note = Synthetic polypeptide
  source 1..370: mol_type = other DNA
atggccgcagaccagcgcccgaaggccgacacgctggccctgaggcaacggctcatcagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggatcattgctggagcttagtgaggtaatatgt

SEQ ID NO: 2735 - DNA, 412 bp, synthetic construct
  misc_feature 1..412: note = Synthetic polypeptide
  source 1..412: mol_type = other DNA
atggccgcagaccagcgcccgaaggccgacacgctggccctgaggcaacggctcatcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaagttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggatcattgctggagcttagtgaggtaatatgt

SEQ ID NO: 2736 - DNA, 351 bp, synthetic construct; identical to SEQ ID NO: 917
  misc_feature 1..351: note = Synthetic polypeptide
  source 1..351: mol_type = other DNA

SEQ ID NO: 2737 - DNA, 211 bp, synthetic construct; identical to SEQ ID NO: 912
  misc_feature 1..211: note = Synthetic polypeptide
  source 1..211: mol_type = other DNA

SEQ ID NO: 2738 - DNA, 2721 bp, synthetic construct; identical to SEQ ID NO: 962
  misc_feature 1..2721: note = Synthetic polypeptide
  source 1..2721: mol_type = other DNA

SEQ ID NO: 2739 - DNA, 2549 bp, synthetic construct; identical to SEQ ID NO: 963
  misc_feature 1..2549: note = Synthetic polypeptide
  source 1..2549: mol_type = other DNA

SEQ ID NO: 2740 - DNA, 1624 bp, synthetic construct
  misc_feature 1..1624: note = Synthetic polypeptide
  source 1..1624: mol_type = other DNA
atgagtaagagcaaatgctccgtgggactcatgtcttccgtggtggccccggctaaggagcccaatgccgtgggcccgaaggaggtggagctcatccttgtcaaggagcagaacggagtgcagctcaccagctccaccctcaccaacccgcggcagagccccgtggaggcccaggatcgggagacctggggcaagaagatcgactttctcctgtccgtcattggctttgctgtggacctggccaacgtctggcggttcccctacctgtgctacaaaaatggtggcggtgccttcctggtcccctacctgctcttcatggtcattgctgggatgccacttttctacatggagctggccctcggccagttcaacagggaaggggccgctggtgtctggaagatctgccccatactgaaaggtgtgggcttcacggtcatcctcatctcactgtatgtcggcttcttctacaacgtcatcatcgcctgggcgctgcactatctcttctcctccttcaccacggagctcccctggatccactgcaacaactcctggaacagccccaactgctcggatgcccatcctggtgactccagtggagacagctcgggcctcaacgacacttttgggaccacacctgctgccgagtactttgaacgtggcgtgctgcacctccaccagagccatggcatcgacgacctggggcctccgcggtggcagctcacagcctgcctggtgctggtcatcgtgctgctctacttcagcctctggaagggcgtgaagacctcagggaaggtggtatggatcacagccaccatgccatacgtggtcctcactgccctgctcctgcgtggggtcaccctccctggagccatagacggcatcagagcatacctgagcgttgacttctaccggctctgcgaggcgtctgtttggattgacgcggccacccaggtgtgcttctccctgggcgtggggttcggggtgctgatcgccttctccagctacaacaagttcaccaacaactgctacagggacgcgattgtcaccacctccatcaactccctgacgagcttctcctccggcttcgtcgtcttctccttcctggggtacatggcacagaagcacagtgtgcccatcggggacgtggccaaggacgggccagggctgatcttcatcatctacccggaagccatcgccacgctccctctgtcctcagcctgggccgtggtcttcttcatcatgctgctcaccctgggtatcgacagcgccatgggtggtatggagtcagtgatcaccgggctcatcgatgagttccagctgctgcacagacaccgtgagctcttcacgctcttcatcgtcctggcgaccttcctcctgtccctgttctgcgtcaccaacggtggcatctacgtcttcacgctcctggaccattttgcagccggcacgtccatcctctttggagtgctcatcgaagccatcggagtggcctggttctatggatggagttctgaagatggacggtggtgacggttacacagtatgtgaatgtattgatacattatgaactctacacgtaaaaatggctaaaatggtaagttttatgttatgtgtattttaccataat

SEQ ID NO: 2741 - DNA, 313 bp, synthetic construct
  misc_feature 1..313: note = Synthetic polypeptide
  source 1..313: mol_type = other DNA
atggctgtctcagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacaatggaggctccatgagaacaaggaatgtgtgttttttcgctaatgcacccatgcctacaactgaccctggcagcgtaagcattcaacagatcattgt

SEQ ID NO: 2742 - DNA, 777 bp, synthetic construct
  misc_feature 1..777: note = Synthetic polypeptide
  source 1..777: mol_type = other DNA
atgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctaccaccgctgggttagggtctccacaaccgagctggtctcggca

SEQ ID NO: 2743 - DNA, 282 bp, synthetic construct
  misc_feature 1..282: note = Synthetic polypeptide
  source 1..282: mol_type = other DNA
atggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctaccaccgctgggttagggtctccacaaccgagctggtctcggca

SEQ ID NO: 2744 - DNA, 490 bp, synthetic construct
  misc_feature 1..490: note = Synthetic polypeptide
  source 1..490: mol_type = other DNA
agggggcggggctgagggacgcagtgcctgggcggtaggcccggtgggcggggctggagaagagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctaccaccgctgggttagggtctccacaaccgagctggtctcggca

SEQ ID NO: 2745 - DNA, 690 bp, synthetic construct
  misc_feature 1..690: note = Synthetic polypeptide
  source 1..690: mol_type = other DNA
atggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgcagtgactcacacctgtaatcccagaaattttgggaggctgaggcaggaagatcatatggggccaggagttcaagaccagcctcagggagaccatcttcacaaaaaataaagaaaaaagaaaa

SEQ ID NO: 2746 - DNA, 690 bp, synthetic construct
  misc_feature 1..690: note = Synthetic polypeptide
  source 1..690: mol_type = other DNA
atggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgacttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgcagtgactcacacctgtaatcccagaaattttgggaggctgaggcaggaagatcatatggggccaggagttcaagaccagcctcagggagaccatcttcacaaaaaataaagaaaaaagaaaa

SEQ ID NO: 2747 - DNA, 825 bp, synthetic construct
  misc_feature 1..825: note = Synthetic polypeptide
  source 1..825: mol_type = other DNA
atggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacagcttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgcagtgactcacacctgtaatcccagaaattttgggaggctgaggcaggaagatcatatggggccaggagttcaagaccagcctcagggagaccatcttcacaaaaaataaagaaaaaagaaaa

SEQ ID NO: 2748 - DNA, 603 bp, synthetic construct
  misc_feature 1..603: note = Synthetic polypeptide
  source 1..603: mol_type = other DNA
atggctgtctcagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacgagtaattctttgcattctggaaatggtcctggttcgaagcccagagttactaaggaggtactccgcaaaagataaatggtaaagatgcattttccttctaaattcaaggttccttgacagttttaactctccacctcccaggcttacttgggacactaatgtatattatgaaagtggctgccatctggctgcctgaagtagactcagaagctggagtcaccaccccttccatcttacagcaggtagaagaggagtcagctcccattctttcttgtcccaacccataaataaagggacagtgatagacttccccttctataggaaccacaaagctgttcataatagaaaaactgggagtcactagaacaagtatttataaatcaatat

SEQ ID NO: 2749 - DNA, 377 bp, synthetic construct; identical to SEQ ID NO: 2235
  misc_feature 1..377: note = Synthetic polypeptide
  source 1..377: mol_type = other DNA

SEQ ID NO: 2750 - DNA, 347 bp, synthetic construct; identical to SEQ ID NO: 2236
  misc_feature 1..347: note = Synthetic polypeptide
  source 1..347: mol_type = other DNA

SEQ ID NO: 2751 - DNA, 4408 bp, synthetic construct
  misc_feature 1..4408: note = Synthetic polypeptide
  source 1..4408: mol_type = other DNA
atgatgaacatgtctttaccttttctttggagtttgcttaccttattaatatttgctgaagtaaatggcgaagctggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagtgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagttgtcactgcccacctgagacgtacggaccccagtgtgcatccaaatatgacgactgtgaagggggttctgtggcacgctgtgtccatggcatctgtgaggatttaatgcgagagcaagctggagagcccaagtacagctgcgtctgtgatgctgggtggatgttttcacccaacagccctgcctgcacgctggacagagacgagtgcagcttccagcccgggccttgctccacacttgtgcagtgtttcaacactcaaggctctttctactgtggggcctgtccaacaggctggcaaggcaatggatatatttgcgaagatatcaatgaatgtgagataaataacggcggctgttctgtggctccacccgttgagtgtgtgaatacacctgggtcttcccactgccaggcctgtccaccagggtaccagggtgacggaagagtgtgcacactcacagacatctgctcagtcagtaatggaggctgccacccagatgcctcatgctcctcaactctaggttccttacctctctgcacgtgtctcccgggttatactggaaatggttatgggccaaatggatgtgtgcagctcagtaatatttgcctaagtcacccctgtctaaatggacaatgcatcgacactgtctctggttatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaagtttgtggagagtccctctcaggaataaatggaagcttcagctacaggagcccggatgttggttatgttcatgatgttaactgcttctgggttatcaaaactgaaatgggaaaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgagattcgagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcgcttgcggggatgaattaactggagaaggggtcattcgctcgcctttttttcctaacgtgtatcctggagaaagaacctgtaggtggaccatccaccagccccaaagccaagtcattctcctcaacttcactgtctttgaaattggaagttctgcccactgtgaaacagattatgttgagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttggcatgtggagaaattcttacagaatcaacagggaccattcaaagtcctggccatccaaatgtctacccccacggtatcaactgtacttggcatatattagtccaacctaatcacctgattcatttaatgttcgaaacatttcatctggagtttcattacaattgcacaaacgactacttggaagtttatgacaccgactctgagacatcccttggaagatactgtggaaagtcgatcccgccatctctcacaagcagtggtaactcattgatgctggtgtttgtgactgactccgacctcgcttatgaaggcttcttaataaactatgaagcaatcagtgcagcaacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcagagatggaggctatgaaaaatcaccattgctgggaatattctatggctcaaatctacccccaacaatcatctctcatagtaacaaactatggttaaaatttaagagtgaccaaatagacacaaggtctggattctcagcttactgggatgggtcatcaacaggttgcgggggtaatctcaccacttcaagcggcacgttcatatctcccaactacccgatgccctattaccacagctctgaatgctactggtggttgaaatctagccacggcagcgcatttgaactggaattcaaagactttcacttggagcatcatccaaactgcactttagattacctggctgtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagacatgtgagaatgtggtaatagtcaatcaaacctatggcatcttagagagtatagggtatccgaatccttattctgaaaatcagcattgcaactggaccatccgggcaacaacaggcaacactgtgaactacacatttttagcatttgacttggaacatcacataaactgctccacagattatttagagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacgaatcaaggccatcaggctacagatggtcttacaaatggaaccccaaatgagctcaactaacaacttctatcaaggacccctggaccgacccactggccctttcattagcctaaagagttcccctctggaggacactacaacttcagggccccttctttgcccctatccagcgggaagtagctagagtggtcatcacccaattcccagcagcagttggggtgtcctgtttagaggggggat

SEQ ID NO: 2752 - DNA, 582 bp, synthetic construct
  misc_feature 1..582: note = Synthetic polypeptide
  source 1..582: mol_type = other DNA
gggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacagtaaaagccaaagttatgcagccacggaaaagaaatgaagcatgaattcacactgcaacgtggataaactgaaaacatgatgctgaaagaggccagacatgaaatgacaaatactgtatgattccacatatatgaaatgtacactaagaagattggcgactgccaggggctgggggagggaggtcttggaaatgacagctcatggatgcagagttttttcctggggtgatgggaattaggtagtggtgatggctgcataatatcgtgaatcaactaaaaaccactgaattgtacactttaaaaaatgaattttg

SEQ ID NO: 2753 - DNA, 511 bp, synthetic construct
  misc_feature 1..511: note = Synthetic polypeptide
  source 1..511: mol_type = other DNA
atggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacagtaaaagccaaagttatgcagccacggaaaagaaatgaagcatgaattcacactgcaacgtggataaactgaaaacatgatgctgaaagaggccagacatgaaatgacaaatactgtatgattccacatatatgaaatgtacactaagaagattggcgactgccaggggctgggggagggaggtcttggaaatgacagctcatggatgcagagttttttcctggggtgatgggaattaggtagtggtgatggctgcataatatcgtgaatcaactaaaaaccactgaattgtacactttaaaaaatgaattttg

SEQ ID NO: 2754 - DNA, 719 bp, synthetic construct
  misc_feature 1..719: note = Synthetic polypeptide
  source 1..719: mol_type = other DNA
agggggcggggctgagggacgcagtgcctgggcggtaggcccggtgggcggggctggagaagagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacagtaaaagccaaagttatgcagccacggaaaagaaatgaagcatgaattcacactgcaacgtggataaactgaaaacatgatgctgaaagaggccagacatgaaatgacaaatactgtatgattccacatatatgaaatgtacactaagaagattggcgactgccaggggctgggggagggaggtcttggaaatgacagctcatggatgcagagttttttcctggggtgatgggaattaggtagtggtgatggctgcataatatcgtgaatcaactaaaaaccactgaattgtacactttaaaaaatgaattttg

SEQ ID NO: 2755 - DNA, 1006 bp, synthetic construct
  misc_feature 1..1006: note = Synthetic polypeptide
  source 1..1006: mol_type = other DNA
atgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacagtaaaagccaaagttatgcagccacggaaaagaaatgaagcatgaattcacactgcaacgtggataaactgaaaacatgatgctgaaagaggccagacatgaaatgacaaatactgtatgattccacatatatgaaatgtacactaagaagattggcgactgccaggggctgggggagggaggtcttggaaatgacagctcatggatgcagagttttttcctggggtgatgggaattaggtagtggtgatggctgcataatatcgtgaatcaactaaaaaccactgaattgtacactttaaaaaatgaattttg

SEQ ID NO: 2756 - DNA, 3308 bp, synthetic construct; identical to SEQ ID NO: 428
  misc_feature 1..3308: note = Synthetic polypeptide
  source 1..3308: mol_type = other DNA

SEQ ID NO: 2757 - DNA, 3203 bp, synthetic construct; identical to SEQ ID NO: 429
  misc_feature 1..3203: note = Synthetic polypeptide
  source 1..3203: mol_type = other DNA

SEQ ID NO: 2758 - DNA, 2849 bp, synthetic construct; identical to SEQ ID NO: 430
  misc_feature 1..2849: note = Synthetic polypeptide
  source 1..2849: mol_type = other DNA

SEQ ID NO: 2759 - DNA, 388 bp, synthetic construct; identical to SEQ ID NO: 431
  misc_feature 1..388: note = Synthetic polypeptide
  source 1..388: mol_type = other DNA

SEQ ID NO: 2760 - DNA, 499 bp, synthetic construct; identical to SEQ ID NO: 2210
  misc_feature 1..499: note = Synthetic polypeptide
  source 1..499: mol_type = other DNA

SEQ ID NO: 2761 - DNA, 331 bp, synthetic construct
  misc_feature 1..331: note = Synthetic polypeptide
  source 1..331: mol_type = other DNA
atgttccaggtcccggatagcgagggcggccgcgccggctccagggtgcagtgactcaacggctgtaatcccggcacttggggaggccgaggcaggtggaccacgagatcaggagatcgagaccatcctggccaacacggtgaaaccccgtctctactaaaaatacgaaaaaattagccgggtgtggggtggcgggtgcctgtagtcccagttccttgagaggctgaggcaggagaatggtgtgaacccgggaggcggagcttgcagtgagccgagatcacaccactgcactccagcctggatgacagagcaagactccgtctcaaagaaa

SEQ ID NO: 2762 - DNA, 1284 bp, synthetic construct; identical to SEQ ID NO: 2536
  misc_feature 1..1284: note = Synthetic polypeptide
  source 1..1284: mol_type = other DNA

SEQ ID NO: 2763 - DNA, 892 bp, synthetic construct
  misc_feature 1..892: note = Synthetic polypeptide
  source 1..892: mol_type = other DNA
atggacagctcccgggaaccgactctggggcgcttggacgccgctggcttctggcaggtctggcagcgctttgatgcggatgaaaaaggttacatagaagagaaggaactcgatgctttctttctccacatgttgatgaaactgggtactgatgacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatgatgaagatttttgacagaaataaagatggtcggttggatctaaatgacttagcaaggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccagttacccacagtgttcaccacagtaacatgctgtacagaaacccaggagaaataggctataccctatagcctaggtgtgtagcaggctctaccatctaagtatgtgtaagtacactctgatgttaatacaacgaaatcggctaatgataaatttcttagaatgtgtatccctgttgataagcaatgtatga

SEQ ID NO: 2764 - DNA, 2161 bp, synthetic construct; identical to SEQ ID NO: 288
  misc_feature 1..2161: note = Synthetic polypeptide
  source 1..2161: mol_type = other DNA

SEQ ID NO: 2765 - DNA, 2140 bp, synthetic construct; identical to SEQ ID NO: 289
  misc_feature 1..2140: note = Synthetic polypeptide
  source 1..2140: mol_type = other DNA

SEQ ID NO: 2766 - DNA, 529 bp, synthetic construct; identical to SEQ ID NO: 287
  misc_feature 1..529: note = Synthetic polypeptide
  source 1..529: mol_type = other DNA

SEQ ID NO: 2767 - DNA, 2117 bp, synthetic construct
  misc_feature 1..2117: note = Synthetic polypeptide
  source 1..2117: mol_type = other DNA
atggatagagcagcgctgcgcgcggcggcgatgggagagaagaaggagggcggtggcgggggggatgcggcggccgcggagggaggcgcaggggccgcggccagccgggcgctgcagcagtgcgggcagctccagaagctcatcgacatctccatcggcagcctgcgcgggctgcgcaccaagtgcgctgtgtccaacgacctcacccagcaggagatacggaccctggaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaaggtaaatcatccagcccagggtggcac

SEQ ID NO: 2768 - DNA, 2183 bp, synthetic construct
  misc_feature 1..2183: note = Synthetic polypeptide
  source 1..2183: mol_type = other DNA
atggatagagcagcgctgcgcgcggcggcgatgggagagaagaaggagggcggtggcgggggggatgcggcggccgcggagggaggcgcaggggccgcggccagccgggcgctgcagcagtgcgggcagctccagaagctcatcgacatctccatcggcagcctgcgcgggctgcgcaccaagtgcgctgtgtccaacgacctcacccagcaggagatacggaccctggaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagtgccatctgctggccattgctggaaatgcctccttattgcagaaagtttaaaggaaaacgctttcaacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaaggtaaatcatccagcccagggtggcac

SEQ ID NO: 2769 - DNA, 1772 bp, synthetic construct
  misc_feature 1..1772: note = Synthetic polypeptide
  source 1..1772: mol_type = other DNA
atgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagtgccatctgctggccattgctggaaatgcctccttattgcagaaagtttaaaggaaaacgctttcaacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaaggtaaatcatccagcccagggtggcac

SEQ ID NO: 2770 - DNA, 1322 bp, synthetic construct
  misc_feature 1..1322: note = Synthetic polypeptide
  source 1..1322: mol_type = other DNA
cacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaaggtaaatcatccagcccagggtggcac

SEQ ID NO: 2771 - DNA, 739 bp, synthetic construct
  misc_feature 1..739: note = Synthetic polypeptide
  source 1..739: mol_type = other DNA
atgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtctga

SEQ ID NO: 2772 - DNA, 988 bp, synthetic construct
  misc_feature 1..988: note = Synthetic polypeptide
  source 1..988: mol_type = other DNA
atggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagggggcctggctgctgtaatctacacggacgccctgcagacgctcatcatggtggtgggggctgtcatcctgacaatcaaagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtctga

SEQ ID NO: 2773 - DNA, 907 bp, synthetic construct
  misc_feature 1..907: note = Synthetic polypeptide
  source 1..907: mol_type = other DNA
atggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtctga

SEQ ID NO: 2774 - DNA, 384 bp, synthetic construct; identical to SEQ ID NO: 968
  misc_feature 1..384: note = Synthetic polypeptide
  source 1..384: mol_type = other DNA

SEQ ID NO: 2775 - DNA, 429 bp, synthetic construct
  misc_feature 1..429: note = Synthetic polypeptide
  source 1..429: mol_type = other DNA
gcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacaggttgccctcaaccctgaagtctcttccagctcttaaaatct

SEQ ID NO: 2776 - DNA, 373 bp, synthetic construct
  misc_feature 1..373: note = Synthetic polypeptide
  source 1..373: mol_type = other DNA
atggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacaggttgccctcaaccctgaagtctcttccagctcttaaaatct

SEQ ID NO: 2777 - DNA, 487 bp, synthetic construct
  misc_feature 1..487: note = Synthetic polypeptide
  source 1..487: mol_type = other DNA
atgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacaggttgccctcaaccctgaagtctcttccagctcttaaaatct

SEQ ID NO: 2778 - DNA, 1218 bp, synthetic construct
  misc_feature 1..1218: note = Synthetic polypeptide
  source 1..1218: mol_type = other DNA
atggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaagggagaagtctggcctaggaggtggaggatgcagcgcaccaagatcgcaccactgtactccaggatgggcaccagagtgagaccttgtctcaaaaaaaaaaaaaaaaaaaaaa

SEQ ID NO: 2779 - DNA, 1326 bp, synthetic construct
  misc_feature 1..1326: note = Synthetic polypeptide
  source 1..1326: mol_type = other DNA
atggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaagggagaagtctggcctaggaggtggaggatgcagcgcaccaagatcgcaccactgtactccaggatgggcaccagagtgagaccttgtctcaaaaaaaaaaaaaaaaaaaaaa

SEQ ID NO: 2780 - DNA, 1236 bp, synthetic construct
  misc_feature 1..1236: note = Synthetic polypeptide
  source 1..1236: mol_type = other DNA
atgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaagggagaagtctggcctaggaggtggaggatgcagcgcaccaagatcgcaccactgtactccaggatgggcaccagagtgagaccttgtctcaaaaaaaaaaaaaaaaaaaaaa

SEQ ID NO: 2781 - DNA, 423 bp, synthetic construct
  misc_feature 1..423: note = Synthetic polypeptide
  source 1..423: mol_type = other DNA
gcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaagggagaagtctggcctaggaggtggaggatgcagcgcaccaagatcgcaccactgtactccaggatgggcaccagagtgagaccttgtctcaaaaaaaaaaaaaaaaaaaaaa

SEQ ID NO: 2782 - DNA, 338 bp, synthetic construct
  misc_feature 1..338: note = Synthetic polypeptide
  source 1..338: mol_type = other DNA
aaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaagggagaagtctggcctaggaggtggaggatgcagcgcaccaagatcgcaccactgtactccaggatgggcaccagagtgagaccttgtctcaaaaaaaaaaaaaaaaaaaaaa

SEQ ID NO: 2783 - DNA, 382 bp, synthetic construct
  misc_feature 1..382: note = Synthetic polypeptide
  source 1..382: mol_type = other DNA
atggcggtcaatgtgtattctacctcgataacccaagagactatgagcagacatgacatcattgcatgggttaatgacatagtatctttaaactacacaaaagtggaacagctttgttcaggatacaaaatcagcgtaacaaaagtcagcagcgtttctgtatgctgataccaaactatctgaaaaattaaggaagcaatcccacttataatcactaccaaaaaaatgagacacctaagaataaacttagcgaaggagctgaaagatttctacaatggaaacatataaaacattgatgaaagaaattgaagaggacataaataaatggaaagccatgccatgtttatggattggaaaaatcaatattgttaaaaagtccata

SEQ ID NO: 2784 - DNA, 475 bp, synthetic construct
  misc_feature 1..475: note = Synthetic polypeptide
  source 1..475: mol_type = other DNA
atgaaacagaacagagatcaaaagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggatacaaaatcagcgtaacaaaagtcagcagcgtttctgtatgctgataccaaactatctgaaaaattaaggaagcaatcccacttataatcactaccaaaaaaatgagacacctaagaataaacttagcgaaggagctgaaagatttctacaatggaaacatataaaacattgatgaaagaaattgaagaggacataaataaatggaaagccatgccatgtttatggattggaaaaatcaatattgttaaaaagtccata

SEQ ID NO: 2785 - DNA, 511 bp, synthetic construct
  misc_feature 1..511: note = Synthetic polypeptide
  source 1..511: mol_type = other DNA
atgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggatacaaaatcagcgtaacaaaagtcagcagcgtttctgtatgctgataccaaactatctgaaaaattaaggaagcaatcccacttataatcactaccaaaaaaatgagacacctaagaataaacttagcgaaggagctgaaagatttctacaatggaaacatataaaacattgatgaaagaaattgaagaggacataaataaatggaaagccatgccatgtttatggattggaaaaatcaatattgttaaaaagtccata

SEQ ID NO: 2786 - DNA, 4292 bp, synthetic construct
  misc_feature 1..4292: note = Synthetic polypeptide
  source 1..4292: mol_type = other DNA
accaaatctactccaaagatccccaaaactgtcaggaattccttggatcaccagaactcatcaactggaaacagcatttacagattcaaagcctaccctaaaagagctcctgaaggaagcactaaacatggaaaggaacaaccggtaccagccactgcaaaatcatgccaaaatataaagaccatcgagactaggaagaaactgcatcaactaacgagcaaaataaccagctaacatcataacggcaggatcaaattcacacagaacaatattaactttaaatgtaaatggactaaatgctccaattaaaagacacagactggcaaattggataaaaagtcaagtcccatcagtgtgctgtattcaggaaacccatctcacgtgcagagacacacataggctcaaaataaaaggatggaggaagatctaccaagcaaatggaaaacaaaaaaaggcaggggttgaaatcccagtctctgacaaaacagactttaaaccaacaaagataaaaagagataaagaaggccattacataatggtaaagggatcaattcacaagaagagctaactatcctaaatatatatgcaaccaatacaggagcacccagattcataaagcaagtcctgagtgacctacaaagagacttagactcccacacaataataatgggagactttaacacaaccactgtcaacattaggcagatccacgagacagaaagttaacaaggatacccaggaattcaactcagctctgcaccaagcagacctaatagacatctacagaactctccacctcagatcagcagaatatacattttttcaacaccacaccacacctattccaaaattgaccacataattggaagtaaagctcgcctcagcaaatgtaaaagaacagaaattataacaaactatctctcagaccacagtgcaatcaaactagaactcaggattaagaaactcactcaaaactgctcaactacacagaaactgaacaacctgctcctgaatgactaccgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaaggaataactaaaatcagagcagaactgaaggagatagagacacaaaaaactcttcaaaaaattaatgaatccaggagctggttttttgaaaggttcaacaaaattgatagaccgctagcaagactaataaagaaacaaggagagaagaatcaaagagacgcaataaaaaatgataaagggggtatcaccaccaatcccacagaaatacaaactaccatcagagaatactacaaacacctctacgcaaataaactagaaaatctagaagaaatggataaattcctcgacacgtacaccctcccaagactaaaccaggaagaagttgattctctgaattgaccaataacaggctctgaaattgtgccaataatcaatagcttaccaaccaaaaagagtccaggaccagatggattcacagccgaattctactagaggtacaaggaggaactggtaccattccttctgaaactattccaatcaatagaaaaagagggaatcctccctaactcattttgtgaggccagcatcatcccgataccaaagcctggcagagacacaaccaaaaaagagaattttagaccaatatctttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaaccacatggttatctcaatagatgcagaaaaggctttgacaaaattcaacaatgcttcatgctaaaaactctcaataaattaggtattgatgggatgtatctcaaaataataagagctatctatgacaaacccacatccaatatcatactgaatgggcaaaaactggaagcattccctttgaaaactggcacaagacagggatgccctctctcaccactcctattcaacttagtgttggaagttctggccagggcaattaggcaggagaaggaaataatgggtattcaattaggaaaagaggaagtcaaattgtccctgtttacagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacttgaaggacttcttcaaggagaactaccaaccaccgctcaaggaaataaaagaggatacaaaaaatggaagaacattccatgctcatgggtaggaagaatcaatatcgtgaaaatggccatactgcccaaggtaatttatagattcaatgccatccccatcaagctaccaatgactttcttaacagaattggaaaaaactacttgaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgatgcatatctacaactatctgatctttgacaaacctgagaaaaacaagcaatggggaaaggattccctatttaataaatggtgctgggaaaactggctagccagatgtagaaagctgaaactggatcccttccttacaccttatacaaaaattaattcaagatggattaaagacttaaacgttagacctaaaatcataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccacatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaaaaaaaaaggtgctcaggtgcaggagaggatgtggagaaataggaacacgtttacactgttggtgggactgtaaactagttcaaccattgtggaagtcagtgtggcgattcctcaaggatctagaactagatataccatttgacccagccatcccattactgggtatatatccaaaggactataaatcatgctgctataaagacacatgcacacgtatgtttattgcagcactattcacaatagcaaagacttggaactaacccacatgtccaacaatgatagactggattaagaaaacgtggcacatatacaccatggaatactatgcagccataaaaaatggtgagttcatgtcctttgtagggacatggatgaaattggaaatcatcattctcagtaaactatcgcaaggacaaaaaaccaaacaccgcatgttctcactcataggtgggaattgaactatgagaacacatggacacaggaaggggaacatcacactctggggacagttgtggggtggggggaggggggagggatagcattaggagatatacctaatgctaaatgacgagttaaggggtgcagcacaccagcatggcacatgtatacataggtaactaacctgcacattgtgcacatgtaccctaaaacttaaagtataataataataaaa

SEQ ID NO: 2787 - DNA, 4518 bp, synthetic construct
  misc_feature 1..4518: note = Synthetic polypeptide
  source 1..4518: mol_type = other DNA
atgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagcctaccctaaaagagctcctgaaggaagcactaaacatggaaaggaacaaccggtaccagccactgcaaaatcatgccaaaatataaagaccatcgagactaggaagaaactgcatcaactaacgagcaaaataaccagctaacatcataacggcaggatcaaattcacacagaacaatattaactttaaatgtaaatggactaaatgctccaattaaaagacacagactggcaaattggataaaaagtcaagtcccatcagtgtgctgtattcaggaaacccatctcacgtgcagagacacacataggctcaaaataaaaggatggaggaagatctaccaagcaaatggaaaacaaaaaaaggcaggggttgaaatcccagtctctgacaaaacagactttaaaccaacaaagataaaaagagataaagaaggccattacataatggtaaagggatcaattcacaagaagagctaactatcctaaatatatatgcaaccaatacaggagcacccagattcataaagcaagtcctgagtgacctacaaagagacttagactcccacacaataataatgggagactttaacacaaccactgtcaacattaggcagatccacgagacagaaagttaacaaggatacccaggaattcaactcagctctgcaccaagcagacctaatagacatctacagaactctccacctcagatcagcagaatatacattttttcaacaccacaccacacctattccaaaattgaccacataattggaagtaaagctcgcctcagcaaatgtaaaagaacagaaattataacaaactatctctcagaccacagtgcaatcaaactagaactcaggattaagaaactcactcaaaactgctcaactacacagaaactgaacaacctgctcctgaatgactaccgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaaggaataactaaaatcagagcagaactgaaggagatagagacacaaaaaactcttcaaaaaattaatgaatccaggagctggttttttgaaaggttcaacaaaattgatagaccgctagcaagactaataaagaaacaaggagagaagaatcaaagagacgcaataaaaaatgataaagggggtatcaccaccaatcccacagaaatacaaactaccatcagagaatactacaaacacctctacgcaaataaactagaaaatctagaagaaatggataaattcctcgacacgtacaccctcccaagactaaaccaggaagaagttgattctctgaattgaccaataacaggctctgaaattgtgccaataatcaatagcttaccaaccaaaaagagtccaggaccagatggattcacagccgaattctactagaggtacaaggaggaactggtaccattccttctgaaactattccaatcaatagaaaaagagggaatcctccctaactcattttgtgaggccagcatcatcccgataccaaagcctggcagagacacaaccaaaaaagagaattttagaccaatatctttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaaccacatggttatctcaatagatgcagaaaaggctttgacaaaattcaacaatgcttcatgctaaaaactctcaataaattaggtattgatgggatgtatctcaaaataataagagctatctatgacaaacccacatccaatatcatactgaatgggcaaaaactggaagcattccctttgaaaactggcacaagacagggatgccctctctcaccactcctattcaacttagtgttggaagttctggccagggcaattaggcaggagaaggaaataatgggtattcaattaggaaaagaggaagtcaaattgtccctgtttacagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacttgaaggacttcttcaaggagaactaccaaccaccgctcaaggaaataaaagaggatacaaaaaatggaagaacattccatgctcatgggtaggaagaatcaatatcgtgaaaatggccatactgcccaaggtaatttatagattcaatgccatccccatcaagctaccaatgactttcttaacagaattggaaaaaactacttgaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgatgcatatctacaactatctgatctttgacaaacctgagaaaaacaagcaatggggaaaggattccctatttaataaatggtgctgggaaaactggctagccagatgtagaaagctgaaactggatcccttccttacaccttatacaaaaattaattcaagatggattaaagacttaaacgttagacctaaaatcataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccacatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaaaaaaaaaggtgctcaggtgcaggagaggatgtggagaaataggaacacgtttacactgttggtgggactgtaaactagttcaaccattgtggaagtcagtgtggcgattcctcaaggatctagaactagatataccatttgacccagccatcccattactgggtatatatccaaaggactataaatcatgctgctataaagacacatgcacacgtatgtttattgcagcactattcacaatagcaaagacttggaactaacccacatgtccaacaatgatagactggattaagaaaacgtggcacatatacaccatggaatactatgcagccataaaaaatggtgagttcatgtcctttgtagggacatggatgaaattggaaatcatcattctcagtaaactatcgcaaggacaaaaaaccaaacaccgcatgttctcactcataggtgggaattgaactatgagaacacatggacacaggaaggggaacatcacactctggggacagttgtggggtggggggaggggggagggatagcattaggagatatacctaatgctaaatgacgagttaaggggtgcagcacaccagcatggcacatgtatacataggtaactaacctgcacattgtgcacatgtaccctaaaacttaaagtataataataataaaa

SEQ ID NO: 2788 - DNA, 809 bp, synthetic construct; identical to SEQ ID NO: 2110
  misc_feature 1..809: note = Synthetic polypeptide
  source 1..809: mol_type = other DNA

SEQ ID NO: 2789 - DNA, 644 bp, synthetic construct; identical to SEQ ID NO: 2111
  misc_feature 1..644: note = Synthetic polypeptide
  source 1..644: mol_type = other DNA

SEQ ID NO: 2790 - DNA, 768 bp, synthetic construct; identical to SEQ ID NO: 2112
  misc_feature 1..768: note = Synthetic polypeptide
  source 1..768: mol_type = other DNA

SEQ ID NO: 2791 - DNA, 427 bp, synthetic construct; identical to SEQ ID NO: 2113
  misc_feature 1..427: note = Synthetic polypeptide
  source 1..427: mol_type = other DNA

SEQ ID NO: 2792 - DNA, 3220 bp, synthetic construct; identical to SEQ ID NO: 248
  misc_feature 1..3220: note = Synthetic polypeptide
  source 1..3220: mol_type = other DNA

SEQ ID NO: 2793 - DNA, 1018 bp, synthetic construct; identical to SEQ ID NO: 1345
  misc_feature 1..1018: note = Synthetic polypeptide
  source 1..1018: mol_type = other DNA

SEQ ID NO: 2794 - DNA, 925 bp, synthetic construct; identical to SEQ ID NO: 1346
  misc_feature 1..925: note = Synthetic polypeptide
  source 1..925: mol_type = other DNA

SEQ ID NO: 2795 - DNA, 736 bp, synthetic construct; identical to SEQ ID NO: 1347
  misc_feature 1..736: note = Synthetic polypeptide
  source 1..736: mol_type = other DNA

SEQ ID NO: 2796 - DNA, 1675 bp, synthetic construct
  misc_feature 1..1675: note = Synthetic polypeptide
  source 1..1675: mol_type = other DNA
atggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccttggaatgcagatgggaaggtgagcaagcttggaccatgaagacaaaggcaacacccgagagatggagcagcttcaagttgaagggagcctgag

SEQ ID NO: 2797 - DNA, 558 bp, synthetic construct
  misc_feature 1..558: note = Synthetic polypeptide
  source 1..558: mol_type = other DNA
atggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaaggaagaa

SEQ ID NO: 2798 - DNA, 3265 bp, synthetic construct
  misc_feature 1..3265: note = Synthetic polypeptide
  source 1..3265: mol_type = other DNA
atgcagcggcgcggcgcggggctcgggtggccgcggcagcagcagcagcaacccccgccgctcgcggtcggcccccgggccgcagccatggtcccgagtggcggcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagctttct

SEQ ID NO: 2799 - DNA, 3160 bp, synthetic construct
  misc_feature 1..3160: note = Synthetic polypeptide
  source 1..3160: mol_type = other DNA
atggcgccccggccaaaaaagcaaccagacaaaaacccattgcacgggcgggaactgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagctttct

SEQ ID NO: 2800 - DNA, 2806 bp, synthetic construct
  misc_feature 1..2806: note = Synthetic polypeptide
  source 1..2806: mol_type = other DNA
atggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagctttct

SEQ ID NO: 2801 - DNA, 345 bp, synthetic construct
  misc_feature 1..345: note = Synthetic polypeptide
  source 1..345: mol_type = other DNA
tgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagctttct

SEQ ID NO: 2802 - DNA, 1399 bp, synthetic construct
  misc_feature 1..1399: note = Synthetic polypeptide
  source 1..1399: mol_type = other DNA
atgctagagaaccatattttacataaaagaatatatatattaacatttttcagtcagcagatatttattttatgtcatgcccatttcattttctttttcactgttagggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagacaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2803 - DNA, 2419 bp, synthetic construct
  misc_feature 1..2419: note = Synthetic polypeptide
  source 1..2419: mol_type = other DNA
atggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagacaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2804 - DNA, 2356 bp, synthetic construct
  misc_feature 1..2356: note = Synthetic polypeptide
  source 1..2356: mol_type = other DNA
atggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagacaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2805 - DNA, 2254 bp, synthetic construct
  misc_feature 1..2254: note = Synthetic polypeptide
  source 1..2254: mol_type = other DNA
atgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagacaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2806 - DNA, 1395 bp, synthetic construct
  misc_feature 1..1395: note = Synthetic polypeptide
  source 1..1395: mol_type = other DNA
atgctagagaaccatattttacataaaagaatatatatattaacatttttcagtcagcagatatttattttatgtcatgcccatttcattttctttttcactgttagggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2807 - DNA, 2415 bp, synthetic construct
  misc_feature 1..2415: note = Synthetic polypeptide
  source 1..2415: mol_type = other DNA
atggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2808 - DNA, 2352 bp, synthetic construct
  misc_feature 1..2352: note = Synthetic polypeptide
  source 1..2352: mol_type = other DNA
atggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2809 - DNA, 2250 bp, synthetic construct
  misc_feature 1..2250: note = Synthetic polypeptide
  source 1..2250: mol_type = other DNA
atgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2810 - DNA, 1649 bp, synthetic construct
  misc_feature 1..1649: note = Synthetic polypeptide
  source 1..1649: mol_type = other DNA
atgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattgccccacctccgacactggggattacgactcaacatgagatctggcggggacaaatgtccaaaccatcccagtctccctcacgttctcccagcggacattggcgagccgctgcccagcgtcaggtgctgggcactgagatgtgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagactccacacttgatggatcagctggcaccacccagatggataaactggctcatctgatcttgtggccccgacccaggaactgactcagcgcaagaagacagctgactccctgtgatatcatccctgatcaatcagcactcccggctcactggctctccacacccaccaagctgtccttaaaaactctgctccccgaatgctcggggagactgatttgagtaataatacagcttcggtctcccacacggccggctctgcatggattactctttctctactgcagttcccctgtcttgataaataggctgtgtctaggcagcgggcaaggtgaa

SEQ ID NO: 2811 - DNA, 1508 bp, synthetic construct
  misc_feature 1..1508: note = Synthetic polypeptide
  source 1..1508: mol_type = other DNA
atgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagactccacacttgatggatcagctggcaccacccagatggataaactggctcatctgatcttgtggccccgacccaggaactgactcagcgcaagaagacagctgactccctgtgatatcatccctgatcaatcagcactcccggctcactggctctccacacccaccaagctgtccttaaaaactctgctccccgaatgctcggggagactgatttgagtaataatacagcttcggtctcccacacggccggctctgcatggattactctttctctactgcagttcccctgtcttgataaataggctgtgtctaggcagcgggcaaggtgaa

SEQ ID NO: 2812 - DNA, 782 bp, synthetic construct
  misc_feature 1..782: note = Synthetic polypeptide
  source 1..782: mol_type = other DNA
ctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagactccacacttgatggatcagctggcaccacccagatggataaactggctcatctgatcttgtggccccgacccaggaactgactcagcgcaagaagacagctgactccctgtgatatcatccctgatcaatcagcactcccggctcactggctctccacacccaccaagctgtccttaaaaactctgctccccgaatgctcggggagactgatttgagtaataatacagcttcggtctcccacacggccggctctgcatggattactctttctctactgcagttcccctgtcttgataaataggctgtgtctaggcagcgggcaaggtgaa

SEQ ID NO: 2813 - DNA, 1504 bp, synthetic construct
  misc_feature 1..1504: note = Synthetic polypeptide
  source 1..1504: mol_type = other DNA
atgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagactccacacttgatggatcagctggcaccacccagatggataaactggctcatctgatcttgtggccccgacccaggaactgactcagcgcaagaagacagctgactccctgtgatatcatccctgatcaatcagcactcccggctcactggctctccacacccaccaagctgtccttaaaaactctgctccccgaatgctcggggagactgatttgagtaataatacagcttcggtctcccacacggccggctctgcatggattactctttctctactgcagttcccctgtcttgataaataggctgtgtctaggcagcgggcaaggtgaa

SEQ ID NO: 2814 - DNA, 1007 bp, synthetic construct
  misc_feature 1..1007: note = Synthetic polypeptide
  source 1..1007: mol_type = other DNA
aactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagactccacacttgatggatcagctggcaccacccagatggataaactggctcatctgatcttgtggccccgacccaggaactgactcagcgcaagaagacagctgactccctgtgatatcatccctgatcaatcagcactcccggctcactggctctccacacccaccaagctgtccttaaaaactctgctccccgaatgctcggggagactgatttgagtaataatacagcttcggtctcccacacggccggctctgcatggattactctttctctactgcagttcccctgtcttgataaataggctgtgtctaggcagcgggcaaggtgaa

SEQ ID NO: 2815 - DNA, 2226 bp, synthetic construct
  misc_feature 1..2226: note = Synthetic polypeptide
  source 1..2226: mol_type = other DNA
atggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgag

SEQ ID NO: 2816 - DNA, 2202 bp, synthetic construct
  misc_feature 1..2202: note = Synthetic polypeptide
  source 1..2202: mol_type = other DNA
atgtgcgggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtggtgctgtaaggggtgactggagggagaagcctggctgctggtcacaccgcttcccttgtcctggccggcatgctctggtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgag

SEQ ID NO: 2817 - DNA, 480 bp, synthetic construct
  misc_feature 1..480: note = Synthetic polypeptide
  source 1..480: mol_type = other DNA
atgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgag

SEQ ID NO: 2818 - DNA, 284 bp, synthetic construct
  misc_feature 1..284: note = Synthetic polypeptide
  source 1..284: mol_type = other DNA
acttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgag

SEQ ID NO: 2819 - DNA, 535 bp, synthetic construct
  misc_feature 1..535: note = Synthetic polypeptide
  source 1..535: mol_type = other DNA
atggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgccagtaatcccagttattcaagaggctgaggcaggagaatcgcttgaacccagggggcagaggttgcagtgagctgagattgcaccacttcactccagcctgggcaacagccaaactccatct

SEQ ID NO: 2820 - DNA, 1079 bp, synthetic construct
  misc_feature 1..1079: note = Synthetic polypeptide
  source 1..1079: mol_type = other DNA
atggcttgtaccatccaaaaggcagaagcacttgacggggctcatttgatgcagatcctctggtatgatgaggaagagtctctctacccagctgtatggttgagagacaactgtccgtgctctgattgctacctggattccgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccagctgtctggaataccctgctctacaaccctttatgcctggaaaactccccttcttccttcaaagttcagcctaagat

SEQ ID NO: 2821 - DNA, 2151 bp, synthetic construct; identical to SEQ ID NO: 127
  misc_feature 1..2151: note = Synthetic polypeptide
  source 1..2151: mol_type = other DNA

SEQ ID NO: 2822 - DNA, 1833 bp, synthetic construct; identical to SEQ ID NO: 126
  misc_feature 1..1833: note = Synthetic polypeptide
  source 1..1833: mol_type = other DNA

SEQ ID NO: 2823 - DNA, 3536 bp, synthetic construct
  misc_feature 1..3536: note = Synthetic polypeptide
  source 1..3536: mol_type = other DNA
atgcagcggcgcggcgcggggctcgggtggccgcggcagcagcagcagcaacccccgccgctcgcggtcggcccccgggccgcagccatggtcccgagtggcggcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagggcgcggtggctcacacctgtaatctcagcaccttgggaggctgaagcaggcagatcacttaaggccagaagttcaagaccagcctgggcaaaatggagaaaccccatctcgactaaaaaatacaaaaattagccgggcatggtggtgcatgcctgtaatcccagctactcaggaggctgaggcagagaatttcttgaacccagaagatggaggttgcagtgagccaaaattgcaccactgcactccagcctgggtgagagagcaagactctgtctc

SEQ ID NO: 2824 - DNA, 3431 bp, synthetic construct
  misc_feature 1..3431: note = Synthetic polypeptide
  source 1..3431: mol_type = other DNA
atggcgccccggccaaaaaagcaaccagacaaaaacccattgcacgggcgggaactgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagggcgcggtggctcacacctgtaatctcagcaccttgggaggctgaagcaggcagatcacttaaggccagaagttcaagaccagcctgggcaaaatggagaaaccccatctcgactaaaaaatacaaaaattagccgggcatggtggtgcatgcctgtaatcccagctactcaggaggctgaggcagagaatttcttgaacccagaagatggaggttgcagtgagccaaaattgcaccactgcactccagcctgggtgagagagcaagactctgtctc

SEQ ID NO: 2825 - DNA, 3077 bp, synthetic construct
  misc_feature 1..3077: note = Synthetic polypeptide
  source 1..3077: mol_type = other DNA
atggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagggcgcggtggctcacacctgtaatctcagcaccttgggaggctgaagcaggcagatcacttaaggccagaagttcaagaccagcctgggcaaaatggagaaaccccatctcgactaaaaaatacaaaaattagccgggcatggtggtgcatgcctgtaatcccagctactcaggaggctgaggcagagaatttcttgaacccagaagatggaggttgcagtgagccaaaattgcaccactgcactccagcctgggtgagagagcaagactctgtctc

SEQ ID NO: 2826 - DNA, 616 bp, synthetic construct
  misc_feature 1..616: note = Synthetic polypeptide
  source 1..616: mol_type = other DNA
tgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagggcgcggtggctcacacctgtaatctcagcaccttgggaggctgaagcaggcagatcacttaaggccagaagttcaagaccagcctgggcaaaatggagaaaccccatctcgactaaaaaatacaaaaattagccgggcatggtggtgcatgcctgtaatcccagctactcaggaggctgaggcagagaatttcttgaacccagaagatggaggttgcagtgagccaaaattgcaccactgcactccagcctgggtgagagagcaagactctgtctc

SEQ ID NO: 2827 - DNA, 1606 bp, synthetic construct; identical to SEQ ID NO: 327
  misc_feature 1..1606: note = Synthetic polypeptide
  source 1..1606: mol_type = other DNA

SEQ ID NO: 2828 - DNA, 175 bp, synthetic construct; identical to SEQ ID NO: 329
  misc_feature 1..175: note = Synthetic polypeptide
  source 1..175: mol_type = other DNA

SEQ ID NO: 2829 - DNA, 2108 bp, synthetic construct
  misc_feature 1..2108: note = Synthetic polypeptide
  source 1..2108: mol_type = other DNA
atgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctacgaagaaagaaccctcttgacaaaatgcagtctctttccatccctcaaagacacagacctagtcacttcctcagaactcctgaaaccgggaaaattgcagagcagtggcaacgtggtaaagcagaaaccgagctatgttaacttgtacagcatttcacatgaacattccaaggacaggaagccatttgaggtggtggcagagaggcctgtgtcctatgtgcagacctacactgccatggacctccatgcagactcgctggatgggacacggtcgggtcctggactgcccacctcagacaccaaagcttctttcgaggcacatgtcagagaaaaattcaatcgaatggttgaggctgtggataggaccattgagaagagaattgataaactcaccaaagagttggcccagaaaactgcggaactgttggaagttcgggcagcttttgtgcagctgactcagaaaaagcaggaagttcagagacgagagcgggccttaaacagacaggtggacgtggccgtggaaatgatagctgtactgaggcaacgcctgacggaatctgaggaggagcttcttaggaaagaagaagaagttgtcacattcaaccatttcctggaagcggcagctgagaaggaggttcaagggaaagcccggctccaggactttattgagaatctgttacagcgggtagaactggcggagaagcagcttgagtactatcagagccagcaggcctctggctttgtccgtgatctcagcgggcacgtgagctggaaaggtgctggcgaagctcgcctggtgtgccaaaatgacctggaattggagatttttggccatataaaccaccatctttcggggttgaaagattctcattgtctagtttttctgcaagccccacctgtgccctggatcattttagccagctttctctggattctcggaaatccctggacgtcttccacggctactgcaggatttagccaaatttgggtgctatttcccttttgtggagggacttttcatcacaatgagaaggacgtcttaggactccaggactttgagaggcttgcccatggctgagcatgaaccaatcagcacacacttccctgcttctgagcccattaaaacgctggactcagccagactcagacagaagtcaggactaacagctgtgggaaggagctacccacttccggtatccttgactcttcaggattacctgcctgcaggtacgagctacccaccatgggtctcctctccactgagagctggacacttgccaggacgacctgtctgtggaaaggagttacccactttgtgtctcctgagagctcctctgttactcagtgaagctcctctccaccttgctcgccctccagttgtccaggcattccattcttcctggacgcaagacaaaaacttgggacctgccaaatggtggggctgaaggagctataatacaaacaggggtaaaacacaaaccccgctctccataatgagagaagagctgtgacccttcaaggagttcagacctgggggctccccaggccagcgttgtgacaccttctttagggctctgtggttcctggtgtctccaagcttctgggcaccactgcgtttctcagtgcccacaatggaagccgcttgtagtacgcctggtccaccatcagccacggacagagccagcacctggagctggcctccccactgcagccagcatgcctggctgtgtgcagtggccagaaacccttcacactcacacatccctcgccactctgcacatggctcacccttgacaggcatggaatctggccagtagctagagctgaatgcagcctgctgggtcaagtgggtggaatgagcccagcggtcccgaggaaaacttgggcaaaggttccactggccacagaggtttccagctggcagagtgacaccctaaagatcctgtgaca

SEQ ID NO: 2830 - DNA, 1370 bp, synthetic construct
  misc_feature 1..1370: note = Synthetic polypeptide
  source 1..1370: mol_type = other DNA
atgtctgcgctgggtcagataaccatcactgtctccaggtgctggaatacagagaggaaccaaacagataaaaatccttgcctgcacggagcttaccttcagctaagggagacagtcaaaaacaagtcaacacatctaaagaagccactgatgaaacaggctcccccttggaaagaccatctcaccttccaacctctccatcctgcagagaggaaaacccaagtttggcgttggcagtcaggtaattcatcagatctggaaaccacctcatcagcatccccctggccaactggaagcaaccgtgacgttgtgctgaatacacttgcagagtcgtgctgtggtctctccgagctcatcacggcacctccctatgcaggagtttcaattcaaggatttagccaaatttgggtgctatttcccttttgtggagggacttttcatcacaatgagaaggacgtcttaggactccaggactttgagaggcttgcccatggctgagcatgaaccaatcagcacacacttccctgcttctgagcccattaaaacgctggactcagccagactcagacagaagtcaggactaacagctgtgggaaggagctacccacttccggtatccttgactcttcaggattacctgcctgcaggtacgagctacccaccatgggtctcctctccactgagagctggacacttgccaggacgacctgtctgtggaaaggagttacccactttgtgtctcctgagagctcctctgttactcagtgaagctcctctccaccttgctcgccctccagttgtccaggcattccattcttcctggacgcaagacaaaaacttgggacctgccaaatggtggggctgaaggagctataatacaaacaggggtaaaacacaaaccccgctctccataatgagagaagagctgtgacccttcaaggagttcagacctgggggctccccaggccagcgttgtgacaccttctttagggctctgtggttcctggtgtctccaagcttctgggcaccactgcgtttctcagtgcccacaatggaagccgcttgtagtacgcctggtccaccatcagccacggacagagccagcacctggagctggcctccccactgcagccagcatgcctggctgtgtgcagtggccagaaacccttcacactcacacatccctcgccactctgcacatggctcacccttgacaggcatggaatctggccagtagctagagctgaatgcagcctgctgggtcaagtgggtggaatgagcccagcggtcccgaggaaaacttgggcaaaggttccactggccacagaggtttccagctggcagagtgacaccctaaagatcctgtgaca

SEQ ID NO: 2831 - DNA, 1723 bp, synthetic construct
  misc_feature 1..1723: note = Synthetic polypeptide
  source 1..1723: mol_type = other DNA
atgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagagcaacatggagagaactggaggtcattatgttaactgaagtaagccaggcacagaaaataaatatcacgtgtttgcactcatgagtaagtgctaaaatagctgatctcatggagataaagagtagagtgatagataccagaggctgggaagggtgtgtgggtggggaagtgggggatgaagggaggttggtgaatgggtagaagcatacagttagcagcaataagttcgaatgttcaatagcagagtagggtgactatagttaacaaccatgtattgtatatttcaaaatagctagaagagaggacttgaaatgttctcaacacacacaaattataaatactcaaggtgatggacaccccaagtatcctaacttgataattaccatatttgcgtgtaacaaaatgtcacttgtacccaatacatatgtacaaatattatgaaatgataaaaa

SEQ ID NO: 2832 - DNA, 1276 bp, synthetic construct
  misc_feature 1..1276: note = Synthetic polypeptide
  source 1..1276: mol_type = other DNA
atgaggcatccaccactcatcactgtgtggagactggaagccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagagcaacatggagagaactggaggtcattatgttaactgaagtaagccaggcacagaaaataaatatcacgtgtttgcactcatgagtaagtgctaaaatagctgatctcatggagataaagagtagagtgatagataccagaggctgggaagggtgtgtgggtggggaagtgggggatgaagggaggttggtgaatgggtagaagcatacagttagcagcaataagttcgaatgttcaatagcagagtagggtgactatagttaacaaccatgtattgtatatttcaaaatagctagaagagaggacttgaaatgttctcaacacacacaaattataaatactcaaggtgatggacaccccaagtatcctaacttgataattaccatatttgcgtgtaacaaaatgtcacttgtacccaatacatatgtacaaatattatgaaatgataaaaa

SEQ ID NO: 2833 - DNA, 1960 bp, synthetic construct
  misc_feature 1..1960: note = Synthetic polypeptide
  source 1..1960: mol_type = other DNA
atgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagagcaacatggagagaactggaggtcattatgttaactgaagtaagccaggcacagaaaataaatatcacgtgtttgcactcatgagtaagtgctaaaatagctgatctcatggagataaagagtagagtgatagataccagaggctgggaagggtgtgtgggtggggaagtgggggatgaagggaggttggtgaatgggtagaagcatacagttagcagcaataagttcgaatgttcaatagcagagtagggtgactatagttaacaaccatgtattgtatatttcaaaatagctagaagagaggacttgaaatgttctcaacacacacaaattataaatactcaaggtgatggacaccccaagtatcctaacttgataattaccatatttgcgtgtaacaaaatgtcacttgtacccaatacatatgtacaaatattatgaaatgataaaaa

SEQ ID NO: 2834 - DNA, 965 bp, synthetic construct; identical to SEQ ID NO: 1035
  misc_feature 1..965: note = Synthetic polypeptide
  source 1..965: mol_type = other DNA

SEQ ID NO: 2835 - DNA, 725 bp, synthetic construct; identical to SEQ ID NO: 1036
  misc_feature 1..725: note = Synthetic polypeptide
  source 1..725: mol_type = other DNA

SEQ ID NO: 2836 - DNA, 1060 bp, synthetic construct
  misc_feature 1..1060: note = Synthetic polypeptide
  source 1..1060: mol_type = other DNA
atggacagctcccgggaaccgactctggggcgcttggacgccgctggcttctggcaggtctggcagcgctttgatgcggatgaaaaaggttacatagaagagaaggaactcgatgctttctttctccacatgttgatgaaactgggtactgatgacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatgatgaagatttttgacagaaataaagatggtcggttggatctaaatgacttagcaaggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccaggcttttgcatttctgatgactggatggccccactggatccatgactcttgactcaactggtcctatggccactactcagaagtggactcagcttcaggaaggccattttccctatccctatgattgctttctcaaccaatcagcagcacccattccctagccccctgcttgccaaactatctttgaaaaaccctagcctccaaattttcggggaggttagtttgagtagtaataaaactctagtctcccttctagcctgttttacatgtattaaactgtttctctattgcaatttccttatattgataaattggctttatctgggcagcaggcaaaagaaacccattgggtggttaca

SEQ ID NO: 2837 - DNA, 443 bp, synthetic construct
  misc_feature 1..443: note = Synthetic polypeptide
  source 1..443: mol_type = other DNA
atgggaagcgcggttatggacaccaagaagaaaaaagatgtttccagccccggcgggagcggcggcaagaaaaatgccagccagaagaggcgttcgctgcgcgtgcacattccgggtcgtttccgatgtgatgagttttgatgaggccacattggagcaggctggcccttttccacatggctggcatctgcgtatgagggggattctggacacagatatgcccggagagacctctggtgaggatgaaggtggagatcaaggtgatgcttctacaagccaggaaaccccaaagatggccggcagccacccgtagctggcagaaaggcctggacagattctccctctcagcctcagagagacccagccctgccgacaccttgatctcggacttccgggctccggaactgggagatggtgcgtttctgttgttcaaagccccccag

SEQ ID NO: 2838 - DNA, 6094 bp, synthetic construct
  misc_feature 1..6094: note = Synthetic polypeptide
  source 1..6094: mol_type = other DNA
atgaaagactccgaagggccccagaggcccccgctgtgttttttatctacattgctttcccagaaggttcctgagaagtcagacgctgtgcttcgctgcataatatctggtcagcccaagccagaggtaacttggtataagaatggtcaggccatcgatgggagtggcattatttccaactatgaattctttgagaatcagtatattcatgtgttacatctctcttgctgtaccaaaaatgatgctgctgtctatcaaatctcggctaaaaactcttttggaatgatctgttgttctgcttccgttgaggttgagtgctcatcagagaacccacaattgtctcctaacctggaagatgacagggacaggggttggaaacatgaaacagggacacatgaagaagaaagggcaaatcagattgatgagaaggaacatccttataaggaagaagaaagcatctccccgggcactcccaggtcagctgactcctccccctccaaatccaaccattcactctccctccagtcattgggcaatcttgacattagtgtgtccagttctgaaaatcctttgggtgttaaaggaacaaggcacactggagaggcttatgatccaagtaacacagaagaaattgcaaatgggttgctttttcttaattcaagtcatatttatgaaaaacaagacagatgttgccacaagacagtgcattccatggcatcaaagttcacggatggtgacctgaacaatgatggtcctcatgatgaaggcttacgctctagtcagcaaaatcccaaagtacagaaatacattagcttcagcctcccgctatctgaggcaactgcacacatttacccaggtgacagtgccgtggccaacaaacaacccagcccacagctttccagtgaagactctgacagtgactatgaactttgcccagagataaccctaacctacaccgaggagttttcagatgatgacctggagtatctggaatgttctgatgttatgacggattactctaatgcagtttggcaaaggaacctgctggggactgagcatgtttttttattagaaagcgatgacgaagagatggaattcggtgagcattgcctgggtgggtgtgagcatttcctcagtggaatgggttgtgggtctcgggtgtcgggtgacgctgggcctatggttgccactgctggcttctgtggtcatcactcacaaccccaagaagttggggtgaggagcagcagagtctccaagcacggtccctcatccccacaaacagggatgactctcattttgggacctcaccaggatggaacgtcttcagtgacagaacaggggagatataaactccccactgctcccgaggctgctgaaaatgattatccaggaattcaaggagaaaccagagacagccaccaagcaagagaggaatttgccagtgacaatctgctcaacatggatgaatcagtaagagagacagagatgaagctcttgtctggtgagtcagaaaactcagggatgagccagtgttgggagacggcagctgacaagagagtggggggaaaggacttatggagcaagaggggttcaaggaaatctgccagggtgaggcagccgggaatgaagggaaatcccaagaagccgaatgccaacctgagagaaagtacaacagaaggtacccttcatctctgctctgccaaagaatctgctgagcccccactaacccagagtgataaaagagagacttctcacaccacagcagcagcgactggtcggagttcccatgctgatgcaagagaatgtgctatttcaacccaggcagagcaagaagcaaaaacccttcaaacttcaacagactcagtctccaaagaaggcaacacaaattgcaagggagaaggcatgcaagttaatactctatttgaaacaagccaggttccagactggagtgatcctcctcaggtacaagttcaggaaacagtcagagagacaatctcttgcagccagatgccagctttctcagagcctgctggggaggagtccccattcactgggaccacaacaatttccttctcaaacttaggaggggtccacaaggaaaatgcatcattagctcaacactcggaggtcaaaccctgtacctgtggtccacagcatgaagaaaaacaagacagagatggcaacatacctgacaatttcagggaagacctaaaatatgagcagagcatctcagaagccaatgatgagactatgtccccaggtgtgttctcaaggcatctccccaaggatgctcgtgctgacttcagggagcctgtggctgtctctgttgcttcccctgaacccacagatactgccctcaccctggaaaatgtgtgtgatgagccaagggacagagaagcagtgtgtgcaatggagtgttttgaggctggtgaccaaggaacgtgttttgataccatagattctcttgttgggagaccagttgataaatattcgcctcaagaaatttgctctgtagatacggaactggcagaaggtcaaaacaaagtatctgatttatgttcttctaatgacaagacactggaagtcttttttcagacacaagtgtctgagacttcagtgtctacgtgcaaaagcagcaaggacggcaactcagtcatgtcccctctttttaccagtactttcaccttgaacatttcacacacagctagtgaaggtgccacaggagaaaatctagccaaggtggagaattccacctacccactggcctccacagtacatgctggccaggagcagccaagccccagcaactcaggagggcttgatgaaacacagctcctttcttctgagaacaatcctttagtgcaatttaaagaaggaggtgacaagagccccagtcctagtgccgcagacaccacagccacaccagccagttatagttcaattgtgagttttccttgggagaagccaacaacattaactgctaataatgagtgctttcaagcgaccagggagactgaggacacatcaactgttaccattgccaccgaagtccacccagccaaataccttgctgtgtcaattcctgaggacaagcatgcaggtggcactgaggagaggttccctcgtgcatcccatgaaaaggtttcccaatttccttcccaagtgcagttggatcatattttaagtggtgctaccatcaaatctacaaaagagctactttgcagggcacccagtgtgccaggagtcccacaccatgtcctgcagctcccagagggagagggtttctgcagtaattcccctcttcaggttgataacctgtctggagataagagccagactgtggacagagcagactttaggagctatgaagagaatttccaagaaagaggaagtgaaacaaagcagggggtccagcagcagagcctgtcccagcagggttctctttctgcacctgatttccaacaaagtttgcctacgacatctgctgcacaagaggaaagaaacttggtgcccacggcccactcacccgcaagctctagggaaggagcagggcagcgctcaggttgggggacgagggtctccgtggtggctgaaactgctggggaagaagacagtcaggctctgagcaacgttccatctctctctgatatccttttggaagagtctaaagaatatagacctggaaattgggaggcaggcaacaagctgaagattataactctagaggcttccgcttctgaaatctggccaccacgacaactgacaaattctgagagcaaggcatcagacggtggtctcataattcctgacaaggtctgggctgtacctgatagtctaaaggcagatgctgttgtgcctgaattggccccctctgaaatagcagcattggctcacagtccagaggatgctgagtcagcccttgctgatagcagagaaagccataaaggcgaagagcccaccatcagtgtacattggagaagtctttcttcccggggtttcagccaacccagactcctggagtcatccgtggaccctgtagatgaaaaggagttatctgtcacagattcactgtcagcggcttctgaaactggagggaaggaaaatgttaacaatgtgagtcaagaccaggaggaaaaacaactcaagatggatcacactgccttctttaaaaagtttctgacctgccctaaaatcctagagtcctctgtagatcccattgatgagataagtgtgatagagtacaccagggctggaaaaccagagccctctgaaaccacaccacagggcgccagagaagggggtcaatcaaatgacggaaacatgggccacgaagcggaaatccagccggccattttgcaagttccatgtctccagggaaccattctgagtgaaaatagaatcagcagaagccaagaaggcagtatgaagcaggaggctgaacaaattcaacctgaggaggcaaaaactgccatttggcaagtcctgcaacccagcgaaggcggtgaaagaattccaagtggatgtagcataggccaaatacaagaaagcagtgatgggagcttaggggaggctgagcaaagcaaaaaggacaaagcagaattgatttcccccacttcacctctttctagttgtcttccaataatgactcacgcttctcttggggttgacacgcacaactccacaggccaaattcatgacgtccctgaaaatgacatagttgagcccagaaagcgtcagtatgtgtttcctgtttcacagaaaaggggaactattgagaatgagcgtgggaaacctttgccctcttctcctgatcttaccaggttcccttgtacttcatctcctgaaggaaatgtcacagactttttgataagccacaaaatggaggaacctaaaatagaggtgcttcaaattggggaaaccaaacccccaagctcatctagctcctcagcgaagaccttggcatttatttcaggagaacgtgagttagagaaagcccctaaattactgcaggatccatgtcaaaagggcaccctgggctgtgcgaaaaagtccagggagagagagaagtccctggaagcccgagcaggcaaatcgccagggaccctcacagcagtgacggggtcagaggaggtcaagaggaagccagaagccccaggcagtggacatttagctgagggagtaaagaagaaaattttgtccagggtggcagcactgaggctgaaactggaagaaaaggaaaatatcagaaagaactcagcctttcttaaaaagatgcccaaactcgaaacatcattatcacacacagaagagaaacaagacccaaaaaagccatcttgcaaaagagaaggaagagctccagtattactgaaaaagatccaagctgagatgttccctgaacactctggaaatgtaaaattaagctgccaatttgcagaaattcatgaagattctactatctgctggacaaaagattcaaagtccatagcccaagtgcagagaagtgcaggggacaactccactgtttcctttgccatcgtgcaagccagtccgaaggaccagggactctattactgctgcatcaagaacagctacggaaaagtgactgctgaatttaacctcacagctgaagttctcaaacagctgtcaagtcgccaggatactaaaggatgtgaagagattgaattcagccaactcatcttcaaagaagacttcctccatgacagctactttgggggccgcctgcgtggtcagatcgccacggaggagctgcactttggagaaggggttcaccgcaaagccttccgcagcacagtgatgcacggcctcatgcctgtcttcaaacctggccatgcctgtgtgcttaaggtgcacaatgccattgcctatgggaccagaaataatgatgagctcatccaaaggaactacaaactcgctgcccaggaatgctatgttcaaaatactgccaggtattatgccaagatctacgctgctgaagcacagcctctggaaggctttggagaagtacctgagaatagcatctggaagagtatctgacacatacaggccactgaataaatattggttgactgaatga

SEQ ID NO: 2839 - DNA, 565 bp, synthetic construct; identical to SEQ ID NO: 1420
  misc_feature 1..565: note = Synthetic polypeptide
  source 1..565: mol_type = other DNA

SEQ ID NO: 2840 - DNA, 1736 bp, synthetic construct; identical to SEQ ID NO: 156
  misc_feature 1..1736: note = Synthetic polypeptide
  source 1..1736: mol_type = other DNA

SEQ ID NO: 2841 - DNA, 1724 bp, synthetic construct; identical to SEQ ID NO: 157
  misc_feature 1..1724: note = Synthetic polypeptide
  source 1..1724: mol_type = other DNA

SEQ ID NO: 2842 - DNA, 535 bp, synthetic construct; identical to SEQ ID NO: 2819
  misc_feature 1..535: note = Synthetic polypeptide
  source 1..535: mol_type = other DNA

SEQ ID NO: 2843 - DNA, 1470 bp, synthetic construct
  misc_feature 1..1470: note = Synthetic polypeptide
  source 1..1470: mol_type = other DNA
atggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttggggtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagttggaatgcagatgggaaggtgagcaagcttggaccatgaagacaaaggcaacacccgagagatggagcagcttcaagttgaagggagcctgag

SEQ ID NO: 2844 - DNA, 1968 bp, synthetic construct
  misc_feature 1..1968: note = Synthetic polypeptide
  source 1..1968: mol_type = other DNA
atggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagttggaatgcagatgggaaggtgagcaagcttggaccatgaagacaaaggcaacacccgagagatggagcagcttcaagttgaagggagcctgag

SEQ ID NO: 2845 - DNA, 843 bp, synthetic construct
  misc_feature 1..843: note = Synthetic polypeptide
  source 1..843: mol_type = other DNA
atggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatggtctccttacctgagaaatgggaatgcccaagctgctgcctcattggctgtttggctgattacatcactggctgagcctgaggccccggacggtgcctgaca

SEQ ID NO: 2846 - DNA, 591 bp, synthetic construct
  misc_feature 1..591: note = Synthetic polypeptide
  source 1..591: mol_type = other DNA
atggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatggtctccttacctgagaaatgggaatgcccaagctgctgcctcattggctgtttggctgattacatcactggctgagcctgaggccccggacggtgcctgaca

SEQ ID NO: 2847 - DNA, 324 bp, synthetic construct
  misc_feature 1..324: note = Synthetic polypeptide
  source 1..324: mol_type = other DNA
gacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatggtctccttacctgagaaatgggaatgcccaagctgctgcctcattggctgtttggctgattacatcactggctgagcctgaggccccggacggtgcctgaca

SEQ ID NO: 2848 - DNA, 1048 bp, synthetic construct
  misc_feature 1..1048: note = Synthetic polypeptide
  source 1..1048: mol_type = other DNA
atggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggctcctgtgtatgactggtctcctcaaatccaaggcatcatctttggtgctgttggctatggtggcatactgacaatggctcccagtggatacctggctggaagagtaggaacaaagcgagtggttggcatttctttgtttgcaacttcatttctcactctatgcatccctctggccactgactttggaatagtcttgctcattgtaactcgaatagtccagggcctaagccagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggctgaactcccttgtccaggcaaccacccagaaacccattgatgccatccttctcctctgccaagtttggtatcagcagctccaggaaaacaactctgaagttggacacccactacttcaaaaccccaaccctgataacagagcccctgttcagcaggaagcaaccagatagtcaacaacacccctttcccttttatattaaagtagaaggcaagaa

SEQ ID NO: 2849 - DNA, 814 bp, synthetic construct
  misc_feature 1..814: note = Synthetic polypeptide
  source 1..814: mol_type = other DNA
atggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggctgaactcccttgtccaggcaaccacccagaaacccattgatgccatccttctcctctgccaagtttggtatcagcagctccaggaaaacaactctgaagttggacacccactacttcaaaaccccaaccctgataacagagcccctgttcagcaggaagcaaccagatagtcaacaacacccctttcccttttatattaaagtagaaggcaagaa

SEQ ID NO: 2850 - DNA, 409 bp, synthetic construct
  misc_feature 1..409: note = Synthetic polypeptide
  source 1..409: mol_type = other DNA
atggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggaggccaagatgggaggacagcttgagggcaggagtttgaggccagcctgggcaatatagcgagacctccatctctacaaagaaattaaaaattagacgggcatggtgacttgcacctgcagtctcagctactcaggaggctgaggtgggaggatggttggagcccagttggtcccactgcactccagccagggcaacagactgagacgct

SEQ ID NO: 2851 - DNA, 617 bp, synthetic construct
  misc_feature 1..617: note = Synthetic polypeptide
  source 1..617: mol_type = other DNA
agggggcggggctgagggacgcagtgcctgggcggtaggcccggtgggcggggctggagaagagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggaggccaagatgggaggacagcttgagggcaggagtttgaggccagcctgggcaatatagcgagacctccatctctacaaagaaattaaaaattagacgggcatggtgacttgcacctgcagtctcagctactcaggaggctgaggtgggaggatggttggagcccagttggtcccactgcactccagccagggcaacagactgagacgct

SEQ ID NO: 2852 - DNA, 904 bp, synthetic construct
  misc_feature 1..904: note = Synthetic polypeptide
  source 1..904: mol_type = other DNA
atgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggaggccaagatgggaggacagcttgagggcaggagtttgaggccagcctgggcaatatagcgagacctccatctctacaaagaaattaaaaattagacgggcatggtgacttgcacctgcagtctcagctactcaggaggctgaggtgggaggatggttggagcccagttggtcccactgcactccagccagggcaacagactgagacgct

SEQ ID NO: 2853 - DNA, 480 bp, synthetic construct
  misc_feature 1..480: note = Synthetic polypeptide
  source 1..480: mol_type = other DNA
gggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggaggccaagatgggaggacagcttgagggcaggagtttgaggccagcctgggcaatatagcgagacctccatctctacaaagaaattaaaaattagacgggcatggtgacttgcacctgcagtctcagctactcaggaggctgaggtgggaggatggttggagcccagttggtcccactgcactccagccagggcaacagactgagacgct

SEQ ID NO: 2854 - DNA, 1742 bp, synthetic construct
  misc_feature 1..1742: note = Synthetic polypeptide
  source 1..1742: mol_type = other DNA
atgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggaggctgaggcaggagatttgcttgaccccgggtggcggaagttgacatgcgctgagatggcaccactgtacttcaccctgggcaacaagagcgaaactctgtctcaaaaaaatgaaaaaa

SEQ ID NO: 2855 - DNA, 317 bp, synthetic construct
  misc_feature 1..317: note = Synthetic polypeptide
  source 1..317: mol_type = other DNA
atggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggaggctgaggcaggagatttgcttgaccccgggtggcggaagttgacatgcgctgagatggcaccactgtacttcaccctgggcaacaagagcgaaactctgtctcaaaaaaatgaaaaaa

SEQ ID NO: 2856 - DNA, 416 bp, synthetic construct
  misc_feature 1..416: note = Synthetic polypeptide
  source 1..416: mol_type = other DNA
ggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggaggctgaggcaggagatttgcttgaccccgggtggcggaagttgacatgcgctgagatggcaccactgtacttcaccctgggcaacaagagcgaaactctgtctcaaaaaaatgaaaaaa

SEQ ID NO: 2857 - DNA, 1097 bp, synthetic construct; identical to SEQ ID NO: 1040
  misc_feature 1..1097: note = Synthetic polypeptide
  source 1..1097: mol_type = other DNA

SEQ ID NO: 2858 - DNA, 965 bp, synthetic construct; identical to SEQ ID NO: 1041
  misc_feature 1..965: note = Synthetic polypeptide
  source 1..965: mol_type = other DNA

SEQ ID NO: 2859 - DNA, 307 bp, synthetic construct; identical to SEQ ID NO: 2622
  misc_feature 1..307: note = Synthetic polypeptide
  source 1..307: mol_type = other DNA

SEQ ID NO: 2860 - DNA, 357 bp, synthetic construct
  misc_feature 1..357: note = Synthetic polypeptide
  source 1..357: mol_type = other DNA
atgtgcaaaggacttgcagctttgccccactcatgcctggaaagggacctggatgaagctggaaaccatcattctcagcaaactattgcaaggacaaaaaaccaaacagcacatgttctcactcataggtgggaattgaacaatgagaacacatggacacaggaagaggaacatcacacaccagggactgttgtggggtagggggaggggggagggatagcattgggagatatacctaatgctaaatgacgagttgatgggtgcagcacaccaacatggtacatgtatacatatgtaacaaacctgcatgttgtgcacaggtaccctaaaacttaaagtataataataataaaaaaa

SEQ ID NO: 2861 - DNA, 1038 bp, synthetic construct
  misc_feature 1..1038: note = Synthetic polypeptide
  source 1..1038: mol_type = other DNA
atgtgtccaggcttacccagacctatgtcacgatcttcattccagctcttcctgcaacctttctttatatgttacaagttaaatatttgctcaaccaggttgagttccagcccgatggccagatctcctggaaatgtgtgtgtcccccccacaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatggctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaatagagattttgcctctacatttttgactt

SEQ ID NO: 2862 - DNA, 1554 bp, synthetic construct
  misc_feature 1..1554: note = Synthetic polypeptide
  source 1..1554: mol_type = other DNA
atggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcgacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatggctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaatagagattttgcctctacatttttgactt

SEQ ID NO: 2863 - DNA, 1623 bp, synthetic construct
  misc_feature 1..1623: note = Synthetic polypeptide
  source 1..1623: mol_type = other DNA
atggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatggctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaatagagattttgcctctacatttttgactt

SEQ ID NO: 2864 - DNA, 606 bp, synthetic construct
  misc_feature 1..606: note = Synthetic polypeptide
  source 1..606: mol_type = other DNA
atgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagctactcgggaggctgaggcaggagaatctcttgaacccggggtgcagaggttgcagtgagctgagatcgcaccactacactccagcctggcgatagagtgagactccatctcaaaaaagaaaaaaaaaaaaaaaaaagaaa

SEQ ID NO: 2865 - DNA, 523 bp, synthetic construct; identical to SEQ ID NO: 1604
  misc_feature 1..523: note = Synthetic polypeptide
  source 1..523: mol_type = other DNA

SEQ ID NO: 2866 - DNA, 661 bp, synthetic construct; identical to SEQ ID NO: 1605
  misc_feature 1..661: note = Synthetic polypeptide
  source 1..661: mol_type = other DNA

SEQ ID NO: 2867 - DNA, 493 bp, synthetic construct; identical to SEQ ID NO: 1606
  misc_feature 1..493: note = Synthetic polypeptide
  source 1..493: mol_type = other DNA

SEQ ID NO: 2868 - DNA, 463 bp, synthetic construct; identical to SEQ ID NO: 1607
  misc_feature 1..463: note = Synthetic polypeptide
  source 1..463: mol_type = other DNA

SEQ ID NO: 2869 - DNA, 436 bp, synthetic construct; identical to SEQ ID NO: 1608
  misc_feature 1..436: note = Synthetic polypeptide
  source 1..436: mol_type = other DNA

SEQ ID NO: 2870 - DNA, 496 bp, synthetic construct; identical to SEQ ID NO: 1609
  misc_feature 1..496: note = Synthetic polypeptide
  source 1..496: mol_type = other DNA

SEQ ID NO: 2871 - DNA, 595 bp, synthetic construct; identical to SEQ ID NO: 1610
  misc_feature 1..595: note = Synthetic polypeptide
  source 1..595: mol_type = other DNA

SEQ ID NO: 2872 - DNA, 634 bp, synthetic construct; identical to SEQ ID NO: 1611
  misc_feature 1..634: note = Synthetic polypeptide
  source 1..634: mol_type = other DNA

SEQ ID NO: 2873 - DNA, 1652 bp, synthetic construct
  misc_feature 1..1652: note = Synthetic polypeptide
  source 1..1652: mol_type = other DNA
atgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcaggcaaaaattggtaaattggacctcatcaaaataaaaaatacttgctctatgaaagaccttcttaagaggatgaaaagaaaagctacaaactgggagaaaatatttgcaaaccacatgtccaacaaaggacttttatctagaacatagaaagaactcagaacccaacagtaaaaagcccaagaaatccaattagaaaattcatgaacagatatttcatcaaaagataaaagataaacagatggtaagtaagcacatgaaaagatgttcaccatcattagctagcagggaaaaaatacaaattaagagcacaataaaagatcactgcacacctctcagaatggctgaaataaaagtgacgacacaaatgctgccaaggttgaggagaaacataatctctcaggtgttgctggtgggaatgaaaattagccactctgaaaaacagtttagtgtttatgttttgttttttttttaataataaaagtaagcttgtgattactgtacaacccagcatttgcaggactaggtgtttatcgtagagaaagggaaaattacattcacataaaaacttgtgcatgaatgttgatagcagcttttttcctaatagctaaaagtgggaaacaactcaaatgtcctttaatgggtgaacagttaaacaactggtcatccatccataccatggaaatatagcaataaaaaggaatgaactctagatacaaggaacagtctggacgaatctctagagaattatgctgagtgaaaaaagataatctcaaaagataaccttctgtatgcttccatttacattacattttcaaaatgtcaaaattatagtcttggagaacagattagtggctgccaggggatttaggggtaggaactctaaagttcacaaaggagccttggggtgatgaccaattctgggtcttaaatgtggtagtagttacacagatctacacatgtgataaaactgcatagaactgtatagacacacatagatgaatgtatgtaaaactggtggaatccgaataaagtttgtgggttgtgccaatgtccatttcttgttttttgataatgttacgccgtttccctttgaggggaaactagtgaaagggtacataggacctgttgtactttttttgggcagcttctggtgaatccttataattatttcaaaataaaaagtt

SEQ ID NO: 2874 - DNA, 2173 bp, synthetic construct
  misc_feature 1..2173: note = Synthetic polypeptide
  source 1..2173: mol_type = other DNA
atgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaagttaccagaggtccaccacagtctgaatgtattaaataggaaattccagaagcaaacagttcataacctttaaagcacgcgccgttctgcacagtctggtgagatcttgatctgtcctgcccaggactcggattctccctttgtccaac

SEQ ID NO: 2875 - DNA, 460 bp, synthetic construct
  misc_feature 1..460: note = Synthetic polypeptide
  source 1..460: mol_type = other DNA
actacagccctgtgtgcggctcggacggcctcatgtacttctcactgtgccacgcagggtgccctgcagccacggagacgaatgtggacggccagaagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaagttaccagaggtccaccacagtctgaatgtattaaataggaaattccagaagcaaacagttcataacctttaaagcacgcgccgttctgcacagtctggtgagatcttgatctgtcctgcccaggactcggattctccctttgtccaac

SEQ ID NO: 2876 - DNA, 670 bp, synthetic construct
  misc_feature 1..670: note = Synthetic polypeptide
  source 1..670: mol_type = other DNA
atgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctagggggtcagccgcaactaagaagtatgaagggtagagaaaaatttcttctcctctcctaca

SEQ ID NO: 2877 - DNA, 604 bp, synthetic construct
  misc_feature 1..604: note = Synthetic polypeptide
  source 1..604: mol_type = other DNA
gagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctagggggtcagccgcaactaagaagtatgaagggtagagaaaaatttcttctcctctcctaca

SEQ ID NO: 2878 - DNA, 550 bp, synthetic construct
  misc_feature 1..550: note = Synthetic polypeptide
  source 1..550: mol_type = other DNA
atgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctagggggtcagccgcaactaagaagtatgaagggtagagaaaaatttcttctcctctcctaca

SEQ ID NO: 2879 - DNA, 500 bp, synthetic construct; identical to SEQ ID NO: 204
  misc_feature 1..500: note = Synthetic polypeptide
  source 1..500: mol_type = other DNA

SEQ ID NO: 2880 - DNA, 656 bp, synthetic construct; identical to SEQ ID NO: 205
  misc_feature 1..656: note = Synthetic polypeptide
  source 1..656: mol_type = other DNA

SEQ ID NO: 2881 - DNA, 524 bp, synthetic construct; identical to SEQ ID NO: 207
  misc_feature 1..524: note = Synthetic polypeptide
  source 1..524: mol_type = other DNA

SEQ ID NO: 2882 - DNA, 620 bp, synthetic construct; identical to SEQ ID NO: 2592
  misc_feature 1..620: note = Synthetic polypeptide
  source 1..620: mol_type = other DNA

SEQ ID NO: 2883 - DNA, 1292 bp, synthetic construct; identical to SEQ ID NO: 2593
  misc_feature 1..1292: note = Synthetic polypeptide
  source 1..1292: mol_type = other DNA

SEQ ID NO: 2884 - DNA, 1400 bp, synthetic construct; identical to SEQ ID NO: 2594
  misc_feature 1..1400: note = Synthetic polypeptide
  source 1..1400: mol_type = other DNA

SEQ ID NO: 2885 - DNA, 1310 bp, synthetic construct; identical to SEQ ID NO: 2595
  misc_feature 1..1310: note = Synthetic polypeptide
  source 1..1310: mol_type = other DNA

SEQ ID NO: 2886 - DNA, 497 bp, synthetic construct; identical to SEQ ID NO: 2596
  misc_feature 1..497: note = Synthetic polypeptide
  source 1..497: mol_type = other DNA

SEQ ID NO: 2887 - DNA, 412 bp, synthetic construct; identical to SEQ ID NO: 2597
  misc_feature 1..412: note = Synthetic polypeptide
  source 1..412: mol_type = other DNA

SEQ ID NO: 2888 - DNA, 610 bp, synthetic construct; identical to SEQ ID NO: 163
  misc_feature 1..610: note = Synthetic polypeptide
  source 1..610: mol_type = other DNA

SEQ ID NO: 2889 - DNA, 842 bp, synthetic construct
  misc_feature 1..842: note = Synthetic polypeptide
  source 1..842: mol_type = other DNA
atggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggctcctgtgtatgactggtctcctcaaatccaaggcatcatctttggtgctgttggctatggtggcatactgacaatggctcccagtggatacctggctggaagagtaggaacaaagcgagtggttggcatttctttgtttgcaacttcatttctcactctatgcatccctctggccactgactttggaatagtcttgctcattgtaactcgaatagtccagggcctaagccagtcctcaatacttgggggtcagtttgcaatttgggaaaagtggggccctccacaagaacgaagcagactctgcagcattgctttatcaggctgaactcccttgtccaggcaaccacccagaaacccattgatgccatccttctcctctgccaagtttggtatcagcagctccaggaaaacaactctgaagttggacacccactacttcaaaaccccaaccctgataacagagcccctgttcagcaggaagcaaccagatagtcaacaacacccctttcccttttatattaaagtagaaggcaagaa

SEQ ID NO: 2890 - DNA, 608 bp, synthetic construct
  misc_feature 1..608: note = Synthetic polypeptide
  source 1..608: mol_type = other DNA
atggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggctgaactcccttgtccaggcaaccacccagaaacccattgatgccatccttctcctctgccaagtttggtatcagcagctccaggaaaacaactctgaagttggacacccactacttcaaaaccccaaccctgataacagagcccctgttcagcaggaagcaaccagatagtcaacaacacccctttcccttttatattaaagtagaaggcaagaa

SEQ ID NO: 2891 - DNA, 734 bp, synthetic construct; identical to SEQ ID NO: 930
  misc_feature 1..734: note = Synthetic polypeptide
  source 1..734: mol_type = other DNA

SEQ ID NO: 2892 - DNA, 1825 bp, synthetic construct; identical to SEQ ID NO: 1660
  misc_feature 1..1825: note = Synthetic polypeptide
  source 1..1825: mol_type = other DNA

SEQ ID NO: 2893 - DNA, 1825 bp, synthetic construct; identical to SEQ ID NO: 1661
  misc_feature 1..1825: note = Synthetic polypeptide
  source 1..1825: mol_type = other DNA

SEQ ID NO: 2894 - DNA, 980 bp, synthetic construct; identical to SEQ ID NO: 2726
  misc_feature 1..980: note = Synthetic polypeptide
  source 1..980: mol_type = other DNA

SEQ ID NO: 2895 - DNA, 2721 bp, synthetic construct; identical to SEQ ID NO: 962
  misc_feature 1..2721: note = Synthetic polypeptide
  source 1..2721: mol_type = other DNA

SEQ ID NO: 2896 - DNA, 2549 bp, synthetic construct; identical to SEQ ID NO: 963
  misc_feature 1..2549: note = Synthetic polypeptide
  source 1..2549: mol_type = other DNA

SEQ ID NO: 2897 - DNA, 3308 bp, synthetic construct; identical to SEQ ID NO: 428
  misc_feature 1..3308: note = Synthetic polypeptide
  source 1..3308: mol_type = other DNA

SEQ ID NO: 2898 - DNA, 3203 bp, synthetic construct; identical to SEQ ID NO: 429
  misc_feature 1..3203: note = Synthetic polypeptide
  source 1..3203: mol_type = other DNA

SEQ ID NO: 2899 - DNA, 2849 bp, synthetic construct; identical to SEQ ID NO: 430
  misc_feature 1..2849: note = Synthetic polypeptide
  source 1..2849: mol_type = other DNA

SEQ ID NO: 2900 - DNA, 388 bp, synthetic construct; identical to SEQ ID NO: 431
  misc_feature 1..388: note = Synthetic polypeptide
  source 1..388: mol_type = other DNA

SEQ ID NO: 2901 - DNA, 860 bp, synthetic construct; identical to SEQ ID NO: 2285
  misc_feature 1..860: note = Synthetic polypeptide
  source 1..860: mol_type = other DNA

SEQ ID NO: 2902 - DNA, 1823 bp, synthetic construct; identical to SEQ ID NO: 2286
  misc_feature 1..1823: note = Synthetic polypeptide
  source 1..1823: mol_type = other DNA

SEQ ID NO: 2903 - DNA, 1796 bp, synthetic construct; identical to SEQ ID NO: 2287
  misc_feature 1..1796: note = Synthetic polypeptide
  source 1..1796: mol_type = other DNA

SEQ ID NO: 2904 - DNA, 322 bp, synthetic construct; identical to SEQ ID NO: 2729
  misc_feature 1..322: note = Synthetic polypeptide
  source 1..322: mol_type = other DNA

SEQ ID NO: 2905 - DNA, 465 bp, synthetic construct; identical to SEQ ID NO: 2730
  misc_feature 1..465: note = Synthetic polypeptide
  source 1..465: mol_type = other DNA

SEQ ID NO: 2906 - DNA, 1663 bp, synthetic construct; identical to SEQ ID NO: 2731
  misc_feature 1..1663: note = Synthetic polypeptide
  source 1..1663: mol_type = other DNA

SEQ ID NO: 2907 - DNA, 1429 bp, synthetic construct; identical to SEQ ID NO: 2732
  misc_feature 1..1429: note = Synthetic polypeptide
  source 1..1429: mol_type = other DNA

SEQ ID NO: 2908 - DNA, 1813 bp, synthetic construct
  misc_feature 1..1813: note = Synthetic polypeptide
  source 1..1813: mol_type = other DNA
atgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccagatgtctgcggaaacatccctcgtcagaagcgcttgctcagttgtacacatgagcccgagggtcctcagcttttctttccataggttccagaggccgtagtttctttgtaagactctaggtgtttatgtgattattggcttaatgtctatttccttcccaggccccataaggggagggctgagtctgtcccgtttatcattaaatcctcagctcaagcccctagcctggcacgcagtaggtgctcaacagaatgaagggaggaatgaat

SEQ ID NO: 2909 - DNA, 1813 bp, synthetic construct
  misc_feature 1..1813: note = Synthetic polypeptide
  source 1..1813: mol_type = other DNA
atgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccagatgtctgcggaaacatccctcgtcagaagcgcttgctcagttgtacacatgagcccgagggtcctcagcttttctttccataggttccagaggccgtagtttctttgtaagactctaggtgtttatgtgattattggcttaatgtctatttccttcccaggccccataaggggagggctgagtctgtcccgtttatcattaaatcctcagctcaagcccctagcctggcacgcagtaggtgctcaacagaatgaagggaggaatgaat

SEQ ID NO: 2910 - DNA, 377 bp, synthetic construct; identical to SEQ ID NO: 2235
  misc_feature 1..377: note = Synthetic polypeptide
  source 1..377: mol_type = other DNA

SEQ ID NO: 2911 - DNA, 347 bp, synthetic construct; identical to SEQ ID NO: 2236
  misc_feature 1..347: note = Synthetic polypeptide
  source 1..347: mol_type = other DNA

SEQ ID NO: 2912 - DNA, 154 bp, synthetic construct; identical to SEQ ID NO: 2227
  misc_feature 1..154: note = Synthetic polypeptide
  source 1..154: mol_type = other DNA

SEQ ID NO: 2913 - DNA, 209 bp, synthetic construct
  misc_feature 1..209: note = Synthetic polypeptide
  source 1..209: mol_type = other DNA
atggacacaagtcccctgtgtttctccattctgttggttttatgcatctttatccaatcaagtgcccttggacaaagcctgaaaccagagctggtcaagcaagaagagcactggactacgcatcaagacctggggtgctgatcccgactctcatccttgactgcagtgtgggctgggcaggtcacttcactgctctgagcgatttagtt

SEQ ID NO: 2914 - DNA, 1271 bp, synthetic construct
  misc_feature 1..1271: note = Synthetic polypeptide
  source 1..1271: mol_type = other DNA
atggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttgaataaagtttattga

SEQ ID NO: 2915 - DNA, 1082 bp, synthetic construct
  misc_feature 1..1082: note = Synthetic polypeptide
  source 1..1082: mol_type = other DNA
atggccaagcgagttgccattgtgggagctggggtcagcggcctggcctccatcaagtgctgtctggaagaaggactggagcccacctgctttgagaggagcgatgaccttggggggctgtggagattcaccaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttgaataaagtttattga

SEQ ID NO: 2916 - DNA, 881 bp, synthetic construct; identical to SEQ ID NO: 2412
  misc_feature 1..881: note = Synthetic polypeptide
  source 1..881: mol_type = other DNA

SEQ ID NO: 2917 - DNA, 803 bp, synthetic construct; identical to SEQ ID NO: 2413
  misc_feature 1..803: note = Synthetic polypeptide
  source 1..803: mol_type = other DNA

SEQ ID NO: 2918 - DNA, 914 bp, synthetic construct
  misc_feature 1..914: note = Synthetic polypeptide
  source 1..914: mol_type = other DNA
atgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatgggtccttggcagatgagatgacctaacgtggcaaagtggttagaccagcg

SEQ ID NO: 2919 - DNA, 620 bp, synthetic construct
  misc_feature 1..620: note = Synthetic polypeptide
  source 1..620: mol_type = other DNA
atgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatgggtccttggcagatgagatgacctaacgtggcaaagtggttagaccagcg

SEQ ID NO: 2920 - DNA, 790 bp, synthetic construct
  misc_feature 1..790: note = Synthetic polypeptide
  source 1..790: mol_type = other DNA
atgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagcttccctctgggcagtaactctaccaacccctccacagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagctgcacagcctcaggaagtcatccatattctctggactcccccgtttggaaatctcagaagacaatgagttctgccctcttcccttctagaactcctgttgtg

SEQ ID NO: 2921 - DNA, 752 bp, synthetic construct
  misc_feature 1..752: note = Synthetic polypeptide
  source 1..752: mol_type = other DNA
atgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagctgcacagcctcaggaagtcatccatattctctggactcccccgtttggaaatctcagaagacaatgagttctgccctcttcccttctagaactcctgttgtg

SEQ ID NO: 2922 - DNA, 742 bp, synthetic construct
  misc_feature 1..742: note = Synthetic polypeptide
  source 1..742: mol_type = other DNA
atgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctgagcagcgggcagcatctggaggaaagcgtgatcccaggaacagccccgtgccccccacaaagaaagctgcacagcctcaggaagtcatccatattctctggactcccccgtttggaaatctcagaagacaatgagttctgccctcttcccttctagaactcctgttgtg

SEQ ID NO: 2923 - DNA, 816 bp, synthetic construct
  misc_feature 1..816: note = Synthetic polypeptide
  source 1..816: mol_type = other DNA
atggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggacacctgtgccgtggacccagccgccatgctgtggggaagcccagcagctcgtagaggggcccatgtggaggggaacccaggcccacggaaccgtggccaggcttccacatgacactgagcccacctgcctgccagccacgtgtgccatcgtgagtggatcctccagtccgaagtggagctaacccggcccaggcctcgtggaatgtctccaccaagccctgcccaagtgcaagtgcaagttcacgggtaa

SEQ ID NO: 2924 - DNA, 769 bp, synthetic construct
  misc_feature 1..769: note = Synthetic polypeptide
  source 1..769: mol_type = other DNA
cgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggacacctgtgccgtggacccagccgccatgctgtggggaagcccagcagctcgtagaggggcccatgtggaggggaacccaggcccacggaaccgtggccaggcttccacatgacactgagcccacctgcctgccagccacgtgtgccatcgtgagtggatcctccagtccgaagtggagctaacccggcccaggcctcgtggaatgtctccaccaagccctgcccaagtgcaagtgcaagttcacgggtaa

SEQ ID NO: 2925 - DNA, 720 bp, synthetic construct
  misc_feature 1..720: note = Synthetic polypeptide
  source 1..720: mol_type = other DNA
gggccccaggatgcaagcacttgttttcctctgggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggacacctgtgccgtggacccagccgccatgctgtggggaagcccagcagctcgtagaggggcccatgtggaggggaacccaggcccacggaaccgtggccaggcttccacatgacactgagcccacctgcctgccagccacgtgtgccatcgtgagtggatcctccagtccgaagtggagctaacccggcccaggcctcgtggaatgtctccaccaagccctgcccaagtgcaagtgcaagttcacgggtaa

SEQ ID NO: 2926 - DNA, 3536 bp, synthetic construct; identical to SEQ ID NO: 2823
  misc_feature 1..3536: note = Synthetic polypeptide
  source 1..3536: mol_type = other DNA

SEQ ID NO: 2927 - DNA, 3431 bp, synthetic construct; identical to SEQ ID NO: 2824
  misc_feature 1..3431: note = Synthetic polypeptide
  source 1..3431: mol_type = other DNA

SEQ ID NO: 2928 - DNA, 3077 bp, synthetic construct; identical to SEQ ID NO: 2825
  misc_feature 1..3077: note = Synthetic polypeptide
  source 1..3077: mol_type = other DNA

SEQ ID NO: 2929 - DNA, 616 bp, synthetic construct; identical to SEQ ID NO: 2826
  misc_feature 1..616: note = Synthetic polypeptide
  source 1..616: mol_type = other DNA

SEQ ID NO: 2930 - DNA, 291 bp, synthetic construct
  misc_feature 1..291: note = Synthetic polypeptide
  source 1..291: mol_type = other DNA
atgcagaacagaactggcctcattctctgtgctcttgccctcctgatgggtttcctgatggtctgcctgggggccttcttcatttcctggggctccatattcgactgtcaggggagcctgattgcggcctatttgcttctgcctctggggtttgtgatccttctgagtggaattttctggagcaactatcgccaggtgactgaaagcaaaggagtgttgaggcacatgctccgacaacaccttgctcatggggccctgcccgtggccacagtagacagagaagagggcttc

SEQ ID NO: 2931 - DNA, 1361 bp, synthetic construct
  misc_feature 1..1361: note = Synthetic polypeptide
  source 1..1361: mol_type = other DNA
atgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggtttctctgttttaatttctgtgtgataaatatgaacagacacagcccacacacgcagaccctcctgggagttttccgtaatttttaagaacatcgatgactgagactcacgagtttgagacccactg

SEQ ID NO: 2932 - DNA, 1118 bp, synthetic construct
  misc_feature 1..1118: note = Synthetic polypeptide
  source 1..1118: mol_type = other DNA
atgccgcagcccgagtcccagaaggcggcgatcctgggctgcgggcaaggcggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggtttctctgttttaatttctgtgtgataaatatgaacagacacagcccacacacgcagaccctcctgggagttttccgtaatttttaagaacatcgatgactgagactcacgagtttgagacccactg

SEQ ID NO: 2933 - DNA, 282 bp, synthetic construct
  misc_feature 1..282: note = Synthetic polypeptide
  source 1..282: mol_type = other DNA
gatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggtttctctgttttaatttctgtgtgataaatatgaacagacacagcccacacacgcagaccctcctgggagttttccgtaatttttaagaacatcgatgactgagactcacgagtttgagacccactg

SEQ ID NO: 2934 - DNA, 500 bp, synthetic construct; identical to SEQ ID NO: 204
  misc_feature 1..500: note = Synthetic polypeptide
  source 1..500: mol_type = other DNA

SEQ ID NO: 2935 - DNA, 656 bp, synthetic construct; identical to SEQ ID NO: 205
  misc_feature 1..656: note = Synthetic polypeptide
  source 1..656: mol_type = other DNA

SEQ ID NO: 2936 - DNA, 524 bp, synthetic construct; identical to SEQ ID NO: 207
  misc_feature 1..524: note = Synthetic polypeptide
  source 1..524: mol_type = other DNA

SEQ ID NO: 2937 - DNA, 1038 bp, synthetic construct; identical to SEQ ID NO: 2861
  misc_feature 1..1038: note = Synthetic polypeptide
  source 1..1038: mol_type = other DNA

SEQ ID NO: 2938 - DNA, 1554 bp, synthetic construct; identical to SEQ ID NO: 2862
  misc_feature 1..1554: note = Synthetic polypeptide
  source 1..1554: mol_type = other DNA

SEQ ID NO: 2939 - DNA, 1623 bp, synthetic construct; identical to SEQ ID NO: 2863
  misc_feature 1..1623: note = Synthetic polypeptide
  source 1..1623: mol_type = other DNA

SEQ ID NO: 2940 - DNA, 319 bp, synthetic construct
  misc_feature 1..319: note = Synthetic polypeptide
  source 1..319: mol_type = other DNA
atggggtccagcagcttcttggtcctcatggtgtctctcgttcttgtgaccctggtggctgtggaaggagttaaagagggtatagagaaagcaggggtttgcccagctgacaacgtacgctgcttcaagtccgatcctccccagtgtcacacagaccaggactgtctgggggaaaggaagtgttgttacctgcactgtggcttcaagtgtgtgattcctgtgaaggaactggaagaagcttagaagacagcacgagagattcacattaaacccaaggaagaacttcctgctgccagggctgtcctggattggaatgggt

SEQ ID NO: 2941 - DNA, 1821 bp, synthetic construct
  misc_feature 1..1821: note = Synthetic polypeptide
  source 1..1821: mol_type = other DNA
atgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggtgtgttggcgggcgcctgtaatcccagctactagggaggctgagacacaagaatgccttgaacccgggaggcggaggttgcagtgagccgagatcgcaccattgcactccagcctgggcaacagagtgagactccatctcaaaaaaaaa

SEQ ID NO: 2942 - DNA, 1821 bp, synthetic construct
  misc_feature 1..1821: note = Synthetic polypeptide
  source 1..1821: mol_type = other DNA
atgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggtgtgttggcgggcgcctgtaatcccagctactagggaggctgagacacaagaatgccttgaacccgggaggcggaggttgcagtgagccgagatcgcaccattgcactccagcctgggcaacagagtgagactccatctcaaaaaaaaa

SEQ ID NO: 2943 - DNA, 739 bp, synthetic construct
  misc_feature 1..739: note = Synthetic polypeptide
  source 1..739: mol_type = other DNA
atggggaatatactgacctgttgtatcaactcccactgtggctggcccagggggaaggacgcaccctgttatgaatctgatactgatatttatgagactgtggctgctgcaacatcagaatccactactgtagagcctggcaagctggatgtgggagccacggagggccaagacctgcagcacatcagcaaccaaaagatgcccacaggtccccctgaggaccgcctgagtttaaaatttctgccatcaagtgaggaagacaatgatgatgccaagattttaccatcacctgtccagggttcttctgaggacaacctgagtttagtatgcctaccacgaagtgaagatgatgactgtgatgatgatgatgatgatgatgcccagattttaccgtcacgtgtccagggtggctgttaccggtttgatagcagttcttgttcttctgaggacaacctgagtttagtatgcctaccacgaagtgaagatgatgactgtgatgatgatgatgatgatgcccagattttaccgtcacctgtccaggcttgttctgaagatagcctgtttttaagatgctcactgagacacaaagatgaagaagaagaagatgatgatgacatccacataacagctcggatagaaagtgacttgacgctggagagtctaagtgatgaagagattcatccagcatcccacaaccatggctggcagatgccaaggggatgtgtgagatggcccagct

SEQ ID NO: 2944 - DNA, 2151 bp, synthetic construct; identical to SEQ ID NO: 127
  misc_feature 1..2151: note = Synthetic polypeptide
  source 1..2151: mol_type = other DNA

SEQ ID NO: 2945 - DNA, 1833 bp, synthetic construct; identical to SEQ ID NO: 126
  misc_feature 1..1833: note = Synthetic polypeptide
  source 1..1833: mol_type = other DNA

SEQ ID NO: 2946 - DNA, 3727 bp, synthetic construct
  misc_feature 1..3727: note = Synthetic polypeptide
  source 1..3727: mol_type = other DNA
atggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtgcacttcataaagcctgtaaaatttttagtaaaattcgaagtggtaagatttatgtgaatgatcttccagtgatcctttgcatcttgagaatttctataagtgatttagaaatgcgacaggcactaaagactgttgatattgatgcattccaggatgccttgaagattttctgtaggataaaaggtggtcgagtttcaactgatgacgtgtttgctgttttggatagcatgggtatccctataaaccgtgaaattttagaagaagtgacaaaacatacctatattgacagtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgctggactgtactgctgccatctcggctcactgcaacctccttgcctgattctcctgcctcagcctgccaagtgcctgcaattgcaggcgcgcgccgccacgcctgactggttttcgtatttttttggtggagacggggtttcgctgtgttggccgggctggtctccagctcctagccgcgagtgatccgccagcctcggcctcccggggtgccgggattgcagacggagtctggttcactcagtgctcaatggtgcccaggctggagtgcagtggcatgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgctcagtctggaaagtgaggagcatctctgcccggccgccatcccatctaggaagtgaggagcgcctcttcccggccgccatcctatctaggaagtgaggagcgtctctgcccggccgcccatcgtctgagatgtggggagagcctctaccccgccgccccgcctgggatgtgaggagcgcctctacccggccgcgaccccatctgggaggtgaggagcgtctctgcccggccgccccgtctgagaagtgaggagaccctccgcctggcaaccgcccgtctgagaagtgaggagcccctccgcccggcagctgccccgtctgagaagtgaagagcccctccacccggcagtcaccccgtctgggaagtgaggagcgtctccacccagcagccaccccatccgggagggaggtgggggtcagcccccgctaggccagccgccccgtccgggagggaggtgggggggtcagccccccgcccggccagccgccccgtccgggagggaggtggggggatcagcccctgcccggccagccgctccgtccgggagggaggttggggggtcagcccgccgcccggccagccgccccgtccgggagggaggtgggggggtcagcccccccctggccagccaccccgtctgggaggtgaggggcgcctctgcccagccgcccctactgggaagtgaggagcccctctgcccggccagccgccccgtccgggagggaggtgggggggtcagccccccgcccggccagccaccccgcccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaatcatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagtgtcctctgcctaggaaaaccagagacctttgttcacttgtttatctgctgaccttgcctccactattgtcctatgaccgtgccaaatccccctctgcgagaaacacccaagaataatcaataa

SEQ ID NO: 2947 - DNA, 3439 bp, synthetic construct
  misc_feature 1..3439: note = Synthetic polypeptide
  source 1..3439: mol_type = other DNA
atggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtggtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgctggactgtactgctgccatctcggctcactgcaacctccttgcctgattctcctgcctcagcctgccaagtgcctgcaattgcaggcgcgcgccgccacgcctgactggttttcgtatttttttggtggagacggggtttcgctgtgttggccgggctggtctccagctcctagccgcgagtgatccgccagcctcggcctcccggggtgccgggattgcagacggagtctggttcactcagtgctcaatggtgcccaggctggagtgcagtggcatgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgctcagtctggaaagtgaggagcatctctgcccggccgccatcccatctaggaagtgaggagcgcctcttcccggccgccatcctatctaggaagtgaggagcgtctctgcccggccgcccatcgtctgagatgtggggagagcctctaccccgccgccccgcctgggatgtgaggagcgcctctacccggccgcgaccccatctgggaggtgaggagcgtctctgcccggccgccccgtctgagaagtgaggagaccctccgcctggcaaccgcccgtctgagaagtgaggagcccctccgcccggcagctgccccgtctgagaagtgaagagcccctccacccggcagtcaccccgtctgggaagtgaggagcgtctccacccagcagccaccccatccgggagggaggtgggggtcagcccccgctaggccagccgccccgtccgggagggaggtgggggggtcagccccccgcccggccagccgccccgtccgggagggaggtggggggatcagcccctgcccggccagccgctccgtccgggagggaggttggggggtcagcccgccgcccggccagccgccccgtccgggagggaggtgggggggtcagcccccccctggccagccaccccgtctgggaggtgaggggcgcctctgcccagccgcccctactgggaagtgaggagcccctctgcccggccagccgccccgtccgggagggaggtgggggggtcagccccccgcccggccagccaccccgcccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaatcatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagtgtcctctgcctaggaaaaccagagacctttgttcacttgtttatctgctgaccttgcctccactattgtcctatgaccgtgccaaatccccctctgcgagaaacacccaagaataatcaataa

SEQ ID NO: 2948 - DNA, 2305 bp, synthetic construct
  misc_feature 1..2305: note = Synthetic polypeptide
  source 1..2305: mol_type = other DNA
gaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgctggactgtactgctgccatctcggctcactgcaacctccttgcctgattctcctgcctcagcctgccaagtgcctgcaattgcaggcgcgcgccgccacgcctgactggttttcgtatttttttggtggagacggggtttcgctgtgttggccgggctggtctccagctcctagccgcgagtgatccgccagcctcggcctcccggggtgccgggattgcagacggagtctggttcactcagtgctcaatggtgcccaggctggagtgcagtggcatgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgctcagtctggaaagtgaggagcatctctgcccggccgccatcccatctaggaagtgaggagcgcctcttcccggccgccatcctatctaggaagtgaggagcgtctctgcccggccgcccatcgtctgagatgtggggagagcctctaccccgccgccccgcctgggatgtgaggagcgcctctacccggccgcgaccccatctgggaggtgaggagcgtctctgcccggccgccccgtctgagaagtgaggagaccctccgcctggcaaccgcccgtctgagaagtgaggagcccctccgcccggcagctgccccgtctgagaagtgaagagcccctccacccggcagtcaccccgtctgggaagtgaggagcgtctccacccagcagccaccccatccgggagggaggtgggggtcagcccccgctaggccagccgccccgtccgggagggaggtgggggggtcagccccccgcccggccagccgccccgtccgggagggaggtggggggatcagcccctgcccggccagccgctccgtccgggagggaggttggggggtcagcccgccgcccggccagccgccccgtccgggagggaggtgggggggtcagcccccccctggccagccaccccgtctgggaggtgaggggcgcctctgcccagccgcccctactgggaagtgaggagcccctctgcccggccagccgccccgtccgggagggaggtgggggggtcagccccccgcccggccagccaccccgcccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaatcatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagtgtcctctgcctaggaaaaccagagacctttgttcacttgtttatctgctgaccttgcctccactattgtcctatgaccgtgccaaatccccctctgcgagaaacacccaagaataatcaataa

SEQ ID NO: 2949 - DNA, 965 bp, synthetic construct; identical to SEQ ID NO: 1035
  misc_feature 1..965: note = Synthetic polypeptide
  source 1..965: mol_type = other DNA

SEQ ID NO: 2950 - DNA, 725 bp, synthetic construct; identical to SEQ ID NO: 1036
  misc_feature 1..725: note = Synthetic polypeptide
  source 1..725: mol_type = other DNA

SEQ ID NO: 2951 - DNA, 884 bp, synthetic construct; identical to SEQ ID NO: 2542
  misc_feature 1..884: note = Synthetic polypeptide
  source 1..884: mol_type = other DNA

SEQ ID NO: 2952 - DNA, 303 bp, synthetic construct; identical to SEQ ID NO: 148
  misc_feature 1..303: note = Synthetic polypeptide
  source 1..303: mol_type = other DNA

SEQ ID NO: 2953 - DNA, 301 bp, synthetic construct; identical to SEQ ID NO: 147
  misc_feature 1..301: note = Synthetic polypeptide
  source 1..301: mol_type = other DNA

SEQ ID NO: 2954 - DNA, 2849 bp, synthetic construct; identical to SEQ ID NO: 1326
  misc_feature 1..2849: note = Synthetic polypeptide
  source 1..2849: mol_type = other DNA

SEQ ID NO: 2955 - DNA, 1925 bp, synthetic construct; identical to SEQ ID NO: 1327
  misc_feature 1..1925: note = Synthetic polypeptide
  source 1..1925: mol_type = other DNA

SEQ ID NO: 2956 - DNA, 2729 bp, synthetic construct; identical to SEQ ID NO: 1328
  misc_feature 1..2729: note = Synthetic polypeptide
  source 1..2729: mol_type = other DNA

SEQ ID NO: 2957 - DNA, 2549 bp, synthetic construct; identical to SEQ ID NO: 1329
  misc_feature 1..2549: note = Synthetic polypeptide
  source 1..2549: mol_type = other DNA

SEQ ID NO: 2958 - DNA, 1428 bp, synthetic construct
  misc_feature 1..1428: note = Synthetic polypeptide
  source 1..1428: mol_type = other DNA
atggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagggatggctgaaggggcaggaggaggagtccccattccaaaccccgggtttgtccatcctccatccatctcactcacaccttagcagggccagttttcatttatttcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgaagatgtcattgccctggtgagccaggtcttgccggtttatagtgtctttcacgtgtttgaggccatctgtgcattgggatgatacagcaagaaggccctcaacagatgttgtcacttgatctgggacttcccagcctccagaaccgtgagccaaataaatttctgttcatcataaattactcagtctagggtattatgttatagcaacacaaaatggactaagaca

SEQ ID NO: 2959 - DNA, 1362 bp, synthetic construct
  misc_feature 1..1362: note = Synthetic polypeptide
  source 1..1362: mol_type = other DNA
atggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgagacacagccatcgtcttgcttatgcagcccatgtcactcggattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgaagatgtcattgccctggtgagccaggtcttgccggtttatagtgtctttcacgtgtttgaggccatctgtgcattgggatgatacagcaagaaggccctcaacagatgttgtcacttgatctgggacttcccagcctccagaaccgtgagccaaataaatttctgttcatcataaattactcagtctagggtattatgttatagcaacacaaaatggactaagaca

SEQ ID NO: 2960 - DNA, 1097 bp, synthetic construct; identical to SEQ ID NO: 1040
  misc_feature 1..1097: note = Synthetic polypeptide
  source 1..1097: mol_type = other DNA

SEQ ID NO: 2961 - DNA, 965 bp, synthetic construct; identical to SEQ ID NO: 1041
  misc_feature 1..965: note = Synthetic polypeptide
  source 1..965: mol_type = other DNA

SEQ ID NO: 2962 - DNA, 3525 bp, synthetic construct
  misc_feature 1..3525: note = Synthetic polypeptide
  source 1..3525: mol_type = other DNA
atgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgaggctacaaccagatcctcatagttcccatgggtgccaccagcatcctcatcgacgaggctgctgccagcaggaacttcctggctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgcctaccccgtgcggtgcctgctgcccagtgcccatggctcttgcgcagactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaactactgtcttctgctgtgcctc

SEQ ID NO: 2963 - DNA, 3444 bp, synthetic construct
  misc_feature 1..3444: note = Synthetic polypeptide
  source 1..3444: mol_type = other DNA
atgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgagctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgcctaccccgtgcggtgcctgctgcccagtgcccatggctcttgcgcagactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaactactgtcttctgctgtgcctc

SEQ ID NO: 2964 - DNA, 3477 bp, synthetic construct
  misc_feature 1..3477: note = Synthetic polypeptide
  source 1..3477: mol_type = other DNA
atgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgaggctacaaccagatcctcatagttcccatgggtgccaccagcatcctcatcgacgaggctgctgccagcaggaacttcctggctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaactactgtcttctgctgtgcctc

SEQ ID NO: 2965 - DNA, 1151 bp, synthetic construct
  misc_feature 1..1151: note = Synthetic polypeptide
  source 1..1151: mol_type = other DNA
atggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaaggactctcagaggctccacaaccctggcccaggatggactcatgacctggactgggctgatggtggtcaccatccccttgatgacagtgattggtggacacatgtactaatcagaatcattccccgacatacagacattgggacacccaaagatttttttttcctgctaaggttattcaactgggaccatgcaaataaacggtaagctgctagtgaccatctttctcagccactttgaagaagccctgcagcaggaaagaatgaggaaaatcagggctggacgatgaaaaaagagtggctcctgatatcatgatttgagccctttattctggttattcctgaaaccacctaattcagccctagacttcccagtgtatgtgaatagtaaatcctcatttttttcttgagctaaaaggatttgggtttctgttacttgcaaaatgagtcttgagtaataca

SEQ ID NO: 2966 - DNA, 1244 bp, synthetic construct
  misc_feature 1..1244: note = Synthetic polypeptide
  source 1..1244: mol_type = other DNA
atgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaaggactctcagaggctccacaaccctggcccaggatggactcatgacctggactgggctgatggtggtcaccatccccttgatgacagtgattggtggacacatgtactaatcagaatcattccccgacatacagacattgggacacccaaagatttttttttcctgctaaggttattcaactgggaccatgcaaataaacggtaagctgctagtgaccatctttctcagccactttgaagaagccctgcagcaggaaagaatgaggaaaatcagggctggacgatgaaaaaagagtggctcctgatatcatgatttgagccctttattctggttattcctgaaaccacctaattcagccctagacttcccagtgtatgtgaatagtaaatcctcatttttttcttgagctaaaaggatttgggtttctgttacttgcaaaatgagtcttgagtaataca

SEQ ID NO: 2967 - DNA, 605 bp, synthetic construct
  misc_feature 1..605: note = Synthetic polypeptide
  source 1..605: mol_type = other DNA
atgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaaggactctcagaggctccacaaccctggcccaggatggactcatgacctggactgggctgatggtggtcaccatccccttgatgacagtgattggtggacacatgtactaatcagaatcattccccgacatacagacattgggacacccaaagatttttttttcctgctaaggttattcaactgggaccatgcaaataaacggtaagctgctagtgaccatctttctcagccactttgaagaagccctgcagcaggaaagaatgaggaaaatcagggctggacgatgaaaaaagagtggctcctgatatcatgatttgagccctttattctggttattcctgaaaccacctaattcagccctagacttcccagtgtatgtgaatagtaaatcctcatttttttcttgagctaaaaggatttgggtttctgttacttgcaaaatgagtcttgagtaataca

SEQ ID NO: 2968 - DNA, 558 bp, synthetic construct; identical to SEQ ID NO: 2797
  misc_feature 1..558: note = Synthetic polypeptide
  source 1..558: mol_type = other DNA

SEQ ID NO: 2969 - DNA, 732 bp, synthetic construct
  misc_feature 1..732: note = Synthetic polypeptide
  source 1..732: mol_type = other DNA
atggcgccggcgcagcgctgccctctgtgccgccagaccttcttctgtggtcgcgggcacgtttacagccgcaagcaccagcggcagctgaaggaggctttggagaggctcctgccccaggtggaggcggcccgcaaggccatccgcgccgctcaggtggagcgctatgtgcccgaacacgagcgatgctgctggtgcctgtgctgcggctgtgaggtgcgggaacacctgagccatggaaacctgacggtgctgtacggggggctgctggagcatctggccagcccagagcacaagaaagcaaccaacaaattctggtgggagaacaaagctgaggtccagatgaaagagaagtttctggtcactccccaggattatgcgcgattcaagaaatccatggtgaaaggtttggattcctatgaagaaaaggaggataaagtgatcaaggagatggcagctcagatccgtgaggtggagcagagccgacaggaggtggttcggtctgtcttagagcctcaggcagtgccagacccagaagagggctcttcagcacctagaagctggaaagggatgaacagccaagtagcttccagcttacagcagccctcaaatttggacctgccaccagctccagagcttgactggatggagacaggaccatctctgacattcattggccatcaggatgaagacagaattattgatacgtacgacacagatgaatctcagaag

SEQ ID NO: 2970 - DNA, 3665 bp, synthetic construct
  misc_feature 1..3665: note = Synthetic polypeptide
  source 1..3665: mol_type = other DNA
atggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtgcacttcataaagcctgtaaaatttttagtaaaattcgaagtggtaagatttatgtgaatgatcttccagtgatcctttgcatcttgagaatttctataagtgatttagaaatgcgacaggcactaaagactgttgatattgatgcattccaggatgccttgaagattttctgtaggataaaaggtggtcgagtttcaactgatgacgtgtttgctgttttggatagcatgggtatccctataaaccgtgaaattttagaagaagtgacaaaacatacctatattgacagtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgcctgccaagtgcctgcaattgcaggcgcgcgccgccacgcctgactggttttcgtatttttttggtggagacggggtttcgctgtgttggccgggctggtctccagctcctagccgcgagtgatccgccagcctcggcctcccggggtgccgggattgcagacggagtctggttcactcagtgctcaatggtgcccaggctggagtgcagtggcatgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgctcagtctggaaagtgaggagcatctctgcccggccgccatcccatctaggaagtgaggagcgcctcttcccggccgccatcctatctaggaagtgaggagcgtctctgcccggccgcccatcgtctgagatgtggggagagcctctaccccgccgccccgcctgggatgtgaggagcgcctctacccggccgcgaccccatctgggaggtgaggagcgtctctgcccggccgccccgtctgagaagtgaggagaccctccgcctggcaaccgcccgtctgagaagtgaggagcccctccgcccggcagctgccccgtctgagaagtgaagagcccctccacccggcagtcaccccgtctgggaagtgaggagcgtctccacccagcagccaccccatccgggagggaggtgggggtcagcccccgctaggccagccgccccgtccgggagggaggtgggggggtcagccccccgcccggccagccgccccgtccgggagggaggtggggggatcagcccctgcccggccagccgctccgtccgggagggaggttggggggtcagcccgccgcccggccagccgccccgtccgggagggaggtgggggggtcagcccccccctggccagccaccccgtctgggaggtgaggggcgcctctgcccagccgcccctactgggaagtgaggagcccctctgcccggccagccgccccgtccgggagggaggtgggggggtcagccccccgcccggccagccaccccgcccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaatcatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagtgtcctctgcctaggaaaaccagagacctttgttcacttgtttatctgctgaccttgcctccactattgtcctatgaccgtgccaaatccccctctgcgagaaacacccaagaataatcaataa

SEQ ID NO: 2971 - DNA, 3377 bp, synthetic construct
  misc_feature 1..3377: note = Synthetic polypeptide
  source 1..3377: mol_type = other DNA
atggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtggtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgcctgccaagtgcctgcaattgcaggcgcgcgccgccacgcctgactggttttcgtatttttttggtggagacggggtttcgctgtgttggccgggctggtctccagctcctagccgcgagtgatccgccagcctcggcctcccggggtgccgggattgcagacggagtctggttcactcagtgctcaatggtgcccaggctggagtgcagtggcatgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgctcagtctggaaagtgaggagcatctctgcccggccgccatcccatctaggaagtgaggagcgcctcttcccggccgccatcctatctaggaagtgaggagcgtctctgcccggccgcccatcgtctgagatgtggggagagcctctaccccgccgccccgcctgggatgtgaggagcgcctctacccggccgcgaccccatctgggaggtgaggagcgtctctgcccggccgccccgtctgagaagtgaggagaccctccgcctggcaaccgcccgtctgagaagtgaggagcccctccgcccggcagctgccccgtctgagaagtgaagagcccctccacccggcagtcaccccgtctgggaagtgaggagcgtctccacccagcagccaccccatccgggagggaggtgggggtcagcccccgctaggccagccgccccgtccgggagggaggtgggggggtcagccccccgcccggccagccgccccgtccgggagggaggtggggggatcagcccctgcccggccagccgctccgtccgggagggaggttggggggtcagcccgccgcccggccagccgccccgtccgggagggaggtgggggggtcagcccccccctggccagccaccccgtctgggaggtgaggggcgcctctgcccagccgcccctactgggaagtgaggagcccctctgcccggccagccgccccgtccgggagggaggtgggggggtcagccccccgcccggccagccaccccgcccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaatcatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagtgtcctctgcctaggaaaaccagagacctttgttcacttgtttatctgctgaccttgcctccactattgtcctatgaccgtgccaaatccccctctgcgagaaacacccaagaataatcaataa

SEQ ID NO: 2972 - DNA, 2243 bp, synthetic construct
  misc_feature 1..2243: note = Synthetic polypeptide
  source 1..2243: mol_type = other DNA
gaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgcctgccaagtgcctgcaattgcaggcgcgcgccgccacgcctgactggttttcgtatttttttggtggagacggggtttcgctgtgttggccgggctggtctccagctcctagccgcgagtgatccgccagcctcggcctcccggggtgccgggattgcagacggagtctggttcactcagtgctcaatggtgcccaggctggagtgcagtggcatgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgctcagtctggaaagtgaggagcatctctgcccggccgccatcccatctaggaagtgaggagcgcctcttcccggccgccatcctatctaggaagtgaggagcgtctctgcccggccgcccatcgtctgagatgtggggagagcctctaccccgccgccccgcctgggatgtgaggagcgcctctacccggccgcgaccccatctgggaggtgaggagcgtctctgcccggccgccccgtctgagaagtgaggagaccctccgcctggcaaccgcccgtctgagaagtgaggagcccctccgcccggcagctgccccgtctgagaagtgaagagcccctccacccggcagtcaccccgtctgggaagtgaggagcgtctccacccagcagccaccccatccgggagggaggtgggggtcagcccccgctaggccagccgccccgtccgggagggaggtgggggggtcagccccccgcccggccagccgccccgtccgggagggaggtggggggatcagcccctgcccggccagccgctccgtccgggagggaggttggggggtcagcccgccgcccggccagccgccccgtccgggagggaggtgggggggtcagcccccccctggccagccaccccgtctgggaggtgaggggcgcctctgcccagccgcccctactgggaagtgaggagcccctctgcccggccagccgccccgtccgggagggaggtgggggggtcagccccccgcccggccagccaccccgcccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaatcatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagtgtcctctgcctaggaaaaccagagacctttgttcacttgtttatctgctgaccttgcctccactattgtcctatgaccgtgccaaatccccctctgcgagaaacacccaagaataatcaataa

SEQ ID NO: 2973 - DNA, 950 bp, synthetic construct; identical to SEQ ID NO: 325
  misc_feature 1..950: note = Synthetic polypeptide
  source 1..950: mol_type = other DNA

SEQ ID NO: 2974 - DNA, 637 bp, synthetic construct; identical to SEQ ID NO: 324
  misc_feature 1..637: note = Synthetic polypeptide
  source 1..637: mol_type = other DNA

SEQ ID NO: 2975 - DNA, 235 bp, synthetic construct; identical to SEQ ID NO: 1657
  misc_feature 1..235: note = Synthetic polypeptide
  source 1..235: mol_type = other DNA

SEQ ID NO: 2976 - DNA, 1078 bp, synthetic construct; identical to SEQ ID NO: 1658
  misc_feature 1..1078: note = Synthetic polypeptide
  source 1..1078: mol_type = other DNA

SEQ ID NO: 2977 - DNA, 609 bp, synthetic construct; identical to SEQ ID NO: 249
  misc_feature 1..609: note = Synthetic polypeptide
  source 1..609: mol_type = other DNA

SEQ ID NO: 2978 - DNA, 738 bp, synthetic construct; identical to SEQ ID NO: 250
  misc_feature 1..738: note = Synthetic polypeptide
  source 1..738: mol_type = other DNA

SEQ ID NO: 2979 - DNA, 537 bp, synthetic construct; identical to SEQ ID NO: 251
  misc_feature 1..537: note = Synthetic polypeptide
  source 1..537: mol_type = other DNA

SEQ ID NO: 2980 - DNA, 684 bp, synthetic construct; identical to SEQ ID NO: 253
  misc_feature 1..684: note = Synthetic polypeptide
  source 1..684: mol_type = other DNA

SEQ ID NO: 2981 - DNA, 285 bp, synthetic construct; identical to SEQ ID NO: 255
  misc_feature 1..285: note = Synthetic polypeptide
  source 1..285: mol_type = other DNA

SEQ ID NO: 2982 - DNA, 552 bp, synthetic construct; identical to SEQ ID NO: 254
  misc_feature 1..552: note = Synthetic polypeptide
  source 1..552: mol_type = other DNA

SEQ ID NO: 2983 - DNA, 124 bp, synthetic construct
  misc_feature 1..124: note = Synthetic polypeptide
  source 1..124: mol_type = other DNA
atggacacaagtcccctgtgtttctccattctgttggttttatgcatctttatccaatcaagtgcccttggacaaagcctgaaaccagagagccagttgctgagtatccaccaatgcaccactg

SEQ ID NO: 2984 - DNA, 645 bp, synthetic construct; identical to SEQ ID NO: 137
  misc_feature 1..645: note = Synthetic polypeptide
  source 1..645: mol_type = other DNA

SEQ ID NO: 2985 - DNA, 1329 bp, synthetic construct
  misc_feature 1..1329: note = Synthetic polypeptide
  source 1..1329: mol_type = other DNA
atgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggttagtttctgcagaaactctacgcgaaatcttgcaagacaaagagctgagtaaggaacagctagtagcatttcttgagaacgtattaaaaacttctgggaaactacgggagaaccttcttcacggtgccttggaacactatgttaattgcctggatctggtaaacaagaggctaccttatggccttgctcagattggagtgtgttttcatcctgtttttgacactaagcagatacgaaatggtgttaaaagtattggtgagaagactgaagcttcgttagtatggtttactcctccgagaacttcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatggccgagatggacgaaaaaatgtggttccttgtgttctctctgtaaatggggacctagaccgaggcatgctggcctacctctatgattctttccagctgacagagaactcctttacaagaaagaaaaatcttcatagaaaggtacttaaacttcacccttgtttagcccctattaaggttgctttggatgtaggaagaggccccacattggaactaagacagctattcaggaggctaaggcacaagaatcacttgaacctgggaggtggaggttgcagtgagccgagatcgcagcactgcactccagcctgggtgacagagcaagaccctgcttcagaaaaaaaaaaaaaaaaaaaaaaa

SEQ ID NO: 2986 - DNA, 588 bp, synthetic construct
  misc_feature 1..588: note = Synthetic polypeptide
  source 1..588: mol_type = other DNA
tcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatggccgagatggacgaaaaaatgtggttccttgtgttctctctgtaaatggggacctagaccgaggcatgctggcctacctctatgattctttccagctgacagagaactcctttacaagaaagaaaaatcttcatagaaaggtacttaaacttcacccttgtttagcccctattaaggttgctttggatgtaggaagaggccccacattggaactaagacagctattcaggaggctaaggcacaagaatcacttgaacctgggaggtggaggttgcagtgagccgagatcgcagcactgcactccagcctgggtgacagagcaagaccctgcttcagaaaaaaaaaaaaaaaaaaaaaaa

SEQ ID NO: 2987 - DNA, 446 bp, synthetic construct; identical to SEQ ID NO: 2206
  misc_feature 1..446: note = Synthetic polypeptide
  source 1..446: mol_type = other DNA

SEQ ID NO: 2988 - DNA, 229 bp, synthetic construct; identical to SEQ ID NO: 2209
  misc_feature 1..229: note = Synthetic polypeptide
  source 1..229: mol_type = other DNA

SEQ ID NO: 2989 - DNA, 802 bp, synthetic construct; identical to SEQ ID NO: 2212
  misc_feature 1..802: note = Synthetic polypeptide
  source 1..802: mol_type = other DNA

SEQ ID NO: 2990 - DNA, 2141 bp, synthetic construct; identical to SEQ ID NO: 2213
  misc_feature 1..2141: note = Synthetic polypeptide
  source 1..2141: mol_type = other DNA

SEQ ID NO: 2991 - DNA, 2192 bp, synthetic construct; identical to SEQ ID NO: 2214
  misc_feature 1..2192: note = Synthetic polypeptide
  source 1..2192: mol_type = other DNA

SEQ ID NO: 2992 - DNA, 2015 bp, synthetic construct; identical to SEQ ID NO: 2215
  misc_feature 1..2015: note = Synthetic polypeptide
  source 1..2015: mol_type = other DNA

SEQ ID NO: 2993 - DNA, 206 bp, synthetic construct; identical to SEQ ID NO: 2207
  misc_feature 1..206: note = Synthetic polypeptide
  source 1..206: mol_type = other DNA

SEQ ID NO: 2994 - DNA, 244 bp, synthetic construct; identical to SEQ ID NO: 2208
  misc_feature 1..244: note = Synthetic polypeptide
  source 1..244: mol_type = other DNA

SEQ ID NO: 2995 - DNA, 499 bp, synthetic construct; identical to SEQ ID NO: 2210
  misc_feature 1..499: note = Synthetic polypeptide
  source 1..499: mol_type = other DNA

SEQ ID NO: 2996 - DNA, 137 bp, synthetic construct
  misc_feature 1..137: note = Synthetic polypeptide
  source 1..137: mol_type = other DNA
atggcagagccagaccgaggaggaggatcgcttgagcccaggaatttgaggctgcagtgagctatgatcgcactattgcactccaacctgggtgacatgagcgagaccctttctctaaaaagtaaaaaagaaagaaa

SEQ ID NO: 2997 - DNA, 669 bp, synthetic construct; identical to SEQ ID NO: 1845
  misc_feature 1..669: note = Synthetic polypeptide
  source 1..669: mol_type = other DNA

SEQ ID NO: 2998 - DNA, 238 bp, synthetic construct; identical to SEQ ID NO: 2234
  misc_feature 1..238: note = Synthetic polypeptide
  source 1..238: mol_type = other DNA

SEQ ID NO: 2999 - DNA, 230 bp, synthetic construct; identical to SEQ ID NO: 2288
  misc_feature 1..230: note = Synthetic polypeptide
  source 1..230: mol_type = other DNA

SEQ ID NO: 3000 - DNA, 235 bp, synthetic construct; identical to SEQ ID NO: 2289
  misc_feature 1..235: note = Synthetic polypeptide
  source 1..235: mol_type = other DNA

SEQ ID NO: 3001 - DNA, 564 bp, synthetic construct; identical to SEQ ID NO: 2295
  misc_feature 1..564: note = Synthetic polypeptide
  source 1..564: mol_type = other DNA

SEQ ID NO: 3002 - DNA, 504 bp, synthetic construct; identical to SEQ ID NO: 2293
  misc_feature 1..504: note = Synthetic polypeptide
  source 1..504: mol_type = other DNA

SEQ ID NO: 3003 - DNA, 378 bp, synthetic construct; identical to SEQ ID NO: 2294
  misc_feature 1..378: note = Synthetic polypeptide
  source 1..378: mol_type = other DNA

SEQ ID NO: 3004 - DNA, 596 bp, synthetic construct
  misc_feature 1..596: note = Synthetic polypeptide
  source 1..596: mol_type = other DNA
atgctggccctgcggctgctcaacgtggtggcccccgcctacttcttgtgcatctccctggtgaccttcgtgctgcagctcttcctcttcctgcccagcatgcgcgaggaccccgcggccgcccggctcttctcgcccgccctgctccacggggcgctcttcctattcctctcggccaacgccctgggcaattacgtccttgtcatccagaactccccagacgacctgggggcctgccagggggcctcggccaggaagactccatgcccctcacctagcacccacttctgccgagtgtgcgccagagtcaccctgaggcacgaccatcactgtttcttcaccggcaactgcatcggcagcaggaacatgcgcaacttcgtcctgttctgcctctacacctccctggcctgcctctactccatggtggccggcgtggcctacatctccgctgtcctttccatctccttcgcccaccccttggccttcctcacgctcctgcccacctccatcagccagttcttctccggttgctgtgtcacctctctgaaccttattcttatctgggaaatggagatgccaccatctgacctgtatct

SEQ ID NO: 3005 - DNA, 2267 bp, synthetic construct; identical to SEQ ID NO: 2277
  misc_feature 1..2267: note = Synthetic polypeptide
  source 1..2267: mol_type = other DNA

SEQ ID NO: 3006 - DNA, 2264 bp, synthetic construct; identical to SEQ ID NO: 2278
  misc_feature 1..2264: note = Synthetic polypeptide
  source 1..2264: mol_type = other DNA

SEQ ID NO: 3007 - DNA, 731 bp, synthetic construct; identical to SEQ ID NO: 2279
  misc_feature 1..731: note = Synthetic polypeptide
  source 1..731: mol_type = other DNA

SEQ ID NO: 3008 - DNA, 1565 bp, synthetic construct; identical to SEQ ID NO: 2280
  misc_feature 1..1565: note = Synthetic polypeptide
  source 1..1565: mol_type = other DNA

SEQ ID NO: 3009 - DNA, 496 bp, synthetic construct; identical to SEQ ID NO: 2298
  misc_feature 1..496: note = Synthetic polypeptide
  source 1..496: mol_type = other DNA

SEQ ID NO: 3010 - DNA, 480 bp, synthetic construct; identical to SEQ ID NO: 2228
  misc_feature 1..480: note = Synthetic polypeptide
  source 1..480: mol_type = other DNA

SEQ ID NO: 3011 - DNA, 410 bp, synthetic construct; identical to SEQ ID NO: 2219
  misc_feature 1..410: note = Synthetic polypeptide
  source 1..410: mol_type = other DNA

SEQ ID NO: 3012 - DNA, 392 bp, synthetic construct; identical to SEQ ID NO: 2220
  misc_feature 1..392: note = Synthetic polypeptide
  source 1..392: mol_type = other DNA

SEQ ID NO: 3013 - DNA, 1770 bp, synthetic construct
  misc_feature 1..1770: note = Synthetic polypeptide
  source 1..1770: mol_type = other DNA
atgcaggggggtgaaccagtgtccacaatgaaagtctcggagagcgaaggaaagctggagggccaggccacagcggtgaccccgaacaagaacagcagctgtggaggtggaatcagtagcagcagcagcagccgcggtggcagtgcaaaaggctggcagtacagtgatcacatggaaaatgtgtatggctatttaatgaagtataccaaccttgtcactgggtggcagtacaggttttttgttttaaacaatgaagctgggctgttggagtactttgtgaatgaacagtctagaaatcagaaacctagaggaactttgcagcttgcaggagctgtaatatcacccagtgatgaggattctcacaccttcactgtaaacgctgccagtggggaacaatataaactcagagctacagatgcaaaagagcgacagcactgggttagcagacttcagatatgtacacagcatcatactgaagctattggaaagaataatcctcctctgaagtcacggagcttctcacttgcatctagtagtaattctcctatatcgcagaggagaccaagtcaaaatgccatttctttttttaatgttggacattccaaactgcaatcactgagcaaaagaactaatttacctccagaccatcttgtggaagtcagagaaatgatgtctcatgctgaaggacaacaaagagacttaattagacgaattgaatgccttcctacttctggccatcttagttccttggaccaggatctcttaatgctcaaagctacttccatggcaactatgaactgcttaaatgactgctttcatattctccagttacagcatgcatcacatcagaagggctcattgccttcaggaacgacaatcgagtggttagaaccaaagatatctttatcaaaccactataaaaatggagctgaccagccctttgcaactgatcagagtaagccggtggcagtcccagaagagcagcctgttgcagaatctggactattagcgagggagcctgaagaaataaatgcagatgatgagatagaggatacatgtgaccacaaagaggatgacctgggagctgtagaagaacaacgtagtgtcatcctacatctcttgtcacagcttaagctgggcatggatttaacaagagtggtgcttcctacatttatcctagagaagcgttccttgctggaaatgtatgcagactttatgtctcatccagacctatttatagccatcactaatggagccacagctgaggacagaatgattcgctttgttgagtactaccttacctcatttcatgaaggccgtaagggagccattgctaaaaaaccatacaatcctatcattggagaaacatttcactgttcctggaagatgccaaaaagcgaggtagcatccagtgtttttagcagttcttccacccagggagtcacaaatcatgctcctttatcgggggagtctttgacccaggtgggatcagactgttacacagtcagatttgttgctgagcaggtttctcatcatcctccagtctcaggattttatgcagaatgtacagagaggaagatgtgtgtaaatgcgcatgtctggactaagagcaagttcttaggcatgtcaataggcgtgacaatggttggagaaggtacttgggagactgaggtggcaggatcacttgagctcaggaaattgaggcagcagtgagccatgatcgtgccactgtactccagcctgcatgacagaggagaaccttgtctcaaa

SEQ ID NO: 3014 - DNA, 1481 bp, synthetic construct; identical to SEQ ID NO: 2275
  misc_feature 1..1481: note = Synthetic polypeptide
  source 1..1481: mol_type = other DNA

SEQ ID NO: 3015 - DNA, 1352 bp, synthetic construct; identical to SEQ ID NO: 2276
  misc_feature 1..1352: note = Synthetic polypeptide
  source 1..1352: mol_type = other DNA

SEQ ID NO: 3016 - DNA, 3391 bp, synthetic construct; identical to SEQ ID NO: 2216
  misc_feature 1..3391: note = Synthetic polypeptide
  source 1..3391: mol_type = other DNA

SEQ ID NO: 3017 - DNA, 1825 bp, synthetic construct; identical to SEQ ID NO: 1660
  misc_feature 1..1825: note = Synthetic polypeptide
  source 1..1825: mol_type = other DNA

SEQ ID NO: 3018 - DNA, 1825 bp, synthetic construct; identical to SEQ ID NO: 1661
  misc_feature 1..1825: note = Synthetic polypeptide
  source 1..1825: mol_type = other DNA

SEQ ID NO: 3019 - DNA, 653 bp, synthetic construct
  misc_feature 1..653: note = Synthetic polypeptide
  source 1..653: mol_type = other DNA
atgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcagggaggccaaagcgggcggatcacctgaggtcgggagtttgagaccagcctgaccaacatggagaaaccccatctctactgaaaatccaaaatagccaggtgtggtggcgcatgcctgtaatcccagctacttgggaggctgaggcaggagaatcgcttgaacccgggaggcggaagttgccatgagctgagattgcgccagtgcactccagcctgggcaacaagagcaaaactccctctcaaaaaaaaaaaaaaaaaaaaaagaa

SEQ ID NO: 3020 - DNA, 710 bp, synthetic construct
  misc_feature 1..710: note = Synthetic polypeptide
  source 1..710: mol_type = other DNA
atgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctgatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcagggaggccaaagcgggcggatcacctgaggtcgggagtttgagaccagcctgaccaacatggagaaaccccatctctactgaaaatccaaaatagccaggtgtggtggcgcatgcctgtaatcccagctacttgggaggctgaggcaggagaatcgcttgaacccgggaggcggaagttgccatgagctgagattgcgccagtgcactccagcctgggcaacaagagcaaaactccctctcaaaaaaaaaaaaaaaaaaaaaagaa

SEQ ID NO: 3021 - DNA, 320 bp, synthetic construct
  misc_feature 1..320: note = Synthetic polypeptide
  source 1..320: mol_type = other DNA
atgagcagggggaaggttattagacttcatcggcggaagcaggacaacatatcagggaggccaaagcgggcggatcacctgaggtcgggagtttgagaccagcctgaccaacatggagaaaccccatctctactgaaaatccaaaatagccaggtgtggtggcgcatgcctgtaatcccagctacttgggaggctgaggcaggagaatcgcttgaacccgggaggcggaagttgccatgagctgagattgcgccagtgcactccagcctgggcaacaagagcaaaactccctctcaaaaaaaaaaaaaaaaaaaaaagaa

SEQ ID NO: 3022 - DNA, 2466 bp, synthetic construct; identical to SEQ ID NO: 1682
  misc_feature 1..2466: note = Synthetic polypeptide
  source 1..2466: mol_type = other DNA

SEQ ID NO: 3023 - DNA, 1806 bp, synthetic construct; identical to SEQ ID NO: 1683
  misc_feature 1..1806: note = Synthetic polypeptide
  source 1..1806: mol_type = other DNA

SEQ ID NO: 3024 - DNA, 2412 bp, synthetic construct; identical to SEQ ID NO: 1684
  misc_feature 1..2412: note = Synthetic polypeptide
  source 1..2412: mol_type = other DNA

SEQ ID NO: 3025 - DNA, 2211 bp, synthetic construct; identical to SEQ ID NO: 1685
  misc_feature 1..2211: note = Synthetic polypeptide
  source 1..2211: mol_type = other DNA

SEQ ID NO: 3026 - DNA, 364 bp, synthetic construct; identical to SEQ ID NO: 1686
  misc_feature 1..364: note = Synthetic polypeptide
  source 1..364: mol_type = other DNA

SEQ ID NO: 3027 - DNA, 500 bp, synthetic construct; identical to SEQ ID NO: 919
  misc_feature 1..500: note = Synthetic polypeptide
  source 1..500: mol_type = other DNA

SEQ ID NO: 3028 - DNA, 1236 bp, synthetic construct; identical to SEQ ID NO: 980
  misc_feature 1..1236: note = Synthetic polypeptide
  source 1..1236: mol_type = other DNA

SEQ ID NO: 3029 - DNA, 1070 bp, synthetic construct
  misc_feature 1..1070: note = Synthetic polypeptide
  source 1..1070: mol_type = other DNA
atgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccagggcatggaaagaggaggtgggactaacagagcagtgaatcactccacacaaaacagcaaaacaggagggaactgagttatttgttggcagctcaagatactggagaagatgacgggccaggaagttgaaagaaggtgagaggttgaggagagaagaggggagctggggagaagctctggccacgtgaaaaccggtagagcctccagaagactgcagccaaggaggaattccttgtggcaaggaatgtctgatgttgaatgttagatggttttctgcgctgtgctgggatgatacaacttgactcaactcttcagttgattgttccctactaacagcaccctggggttagtgttgctttggttgaaaggaag

SEQ ID NO: 3030 - DNA, 177 bp, synthetic construct; identical to SEQ ID NO: 1886
  misc_feature 1..177: note = Synthetic polypeptide
  source 1..177: mol_type = other DNA

SEQ ID NO: 3031 - DNA, 1063 bp, synthetic construct; identical to SEQ ID NO: 2221
  misc_feature 1..1063: note = Synthetic polypeptide
  source 1..1063: mol_type = other DNA

SEQ ID NO: 3032 - DNA, 394 bp, synthetic construct
  misc_feature 1..394: note = Synthetic polypeptide
  source 1..394: mol_type = other DNA
atgtcgtacagacgagaactagagaaataccgtgacctggatgaagatgaaatccttggagccctaacagaggaagagctgaggaccctggaaaatgagctggatgagctggaccctgataatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggcctccttctgctgttctcaaactttccacctcaggacctttgcacatactccctatgcctggagtgctggtcctgctgcccagctccatgctgtcttcttcatggctggctcctcc

SEQ ID NO: 3033 - DNA, 1150 bp, synthetic construct; identical to SEQ ID NO: 2329
  misc_feature 1..1150: note = Synthetic polypeptide
  source 1..1150: mol_type = other DNA

SEQ ID NO: 3034 - DNA, 1009 bp, synthetic construct; identical to SEQ ID NO: 2330
  misc_feature 1..1009: note = Synthetic polypeptide
  source 1..1009: mol_type = other DNA

SEQ ID NO: 3035 - DNA, 993 bp, synthetic construct; identical to SEQ ID NO: 2244
  misc_feature 1..993: note = Synthetic polypeptide
  source 1..993: mol_type = other DNA

SEQ ID NO: 3036 - DNA, 941 bp, synthetic construct; identical to SEQ ID NO: 2706
  misc_feature 1..941: note = Synthetic polypeptide
  source 1..941: mol_type = other DNA

SEQ ID NO: 3037 - DNA, 913 bp, synthetic construct; identical to SEQ ID NO: 2707
  misc_feature 1..913: note = Synthetic polypeptide
  source 1..913: mol_type = other DNA

SEQ ID NO: 3038 - DNA, 1306 bp, synthetic construct
  misc_feature 1..1306: note = Synthetic polypeptide
  source 1..1306: mol_type = other DNA
atgcagccccgccgcgcccaggcgcccggtgcgcagctgctgcccgcgctggccctgctgctgctgctgctcggagcggggccccgaggcagctccctggccaacccggtgcccgccgcgcccctgtctgcgcccgggccgtgcgccgcgcagccctgccggaatgggggtgtgtgcacctcgcgccctgagccggacccgcagcacccggcccccgccggcgagcctggctacagctgcacctgccccgccgggatctccggcgccaactgccagcttgttgcagatccttgtgccagcaacccttgtcaccatggcaactgcagcagcagcagcagcagcagcagcgatggctacctctgcatttgcaatgaaggctatgaaggtcccaactgtgaacaggcacttcccagtctcccagccactggctggaccgaatccatggcaccccgacagcttcagcctgttcctgctactcaggagcctgacaaaatcctgcctcgctctcaggcaacggtgacactgcctacctggcagccgaaaacagggcagaaagttgtagaaatgaaatgggatcaagtggaggtgatcccagatattgcctgtgggaatgccagttctaacagctctgcgggtggccgcctggtatcctttgaagtgccacagaacacctcagtcaagattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggttttgtgaatgattctgtgactaagtctattgtggctttgcgcttaactctggtggtgaaggtcagcacctgtgtgccgggggagagtcacgcaaatgacttggagtgttcaggaaaaggaaaatgcaccacgaagccgtcagaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctgcatgtaaagaaggacatgtttgcttactcttcctccatgattgtaagtttcttgaggccccccagccctgtggaactgtgagtcaattaaacctctttcctttataaattacccagttttgggtatttcttcatagcagcatgagaacagactaataca

SEQ ID NO: 3039 - DNA, 977 bp, synthetic construct
  misc_feature 1..977: note = Synthetic polypeptide
  source 1..977: mol_type = other DNA
atgaagcacatcccggtcctcgaggacgggccgtggaagaccgtgtgcgtgaaggagctgaacggccttaagaagctcaagcggaaaggcaaggagccggcgcggcgcgcgaacggctataaaactttccgactggacttggaagcgcccgagccccgcgccgtagccaccaacgggctgcgggacaggacccatcggctgcagccggtcccggtaccggtgccggtgccagtcccagtggcgccggccgttcccccaagagggggcacggacacagccggggagcgcgggggctctcgggcgcccgaggtctccgacgcgcggaaacgctgcttcgccctaggcgcagtggggccaggactccccacgccgccgccgccgccgcctcctgcgccccagagccaggcacctgggggcccagaggcacagcctttccgggagccgggtctgcgtcctcgcatcttgctgtgcgcaccgcccgcgcgccccgcgccgtcagcacccccagcaccgccagcgcccccggagtccactgtgcgccctgcgcccccgacgcgccccggggaaagttcctactcgtcaatttcacacgtaatttacaataaccaccaggattcctccgcgtcgcctaggaaacgaccgggcgaagcgactgccgcctcctccgagatcaaagccctgcagcagacccggaggctcctggcgaacgccagggagcggacgcgggtgcacaccatcagcgcagccttcgaggcgctcaggaagcaggtgccgtgctactcatatgggcagaagctgtccaaactggccatcctgaggatcgcctgtaactacatcctgtccctggcgcggctggctgaccttgactacagtgccgaccacagcaacctcagcttctccgagtgtgtgcagcgctgcacccgcaccctgcaggccgagggacgtgccaagaagcgcaaggttctgctaacagtggg

SEQ ID NO: 3040 - DNA, 600 bp, synthetic construct
  misc_feature 1..600: note = Synthetic polypeptide
  source 1..600: mol_type = other DNA
gtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3041 - DNA, 720 bp, synthetic construct
  misc_feature 1..720: note = Synthetic polypeptide
  source 1..720: mol_type = other DNA
cagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3042 - DNA, 788 bp, synthetic construct
  misc_feature 1..788: note = Synthetic polypeptide
  source 1..788: mol_type = other DNA
gcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3043 - DNA, 1735 bp, synthetic construct
  misc_feature 1..1735: note = Synthetic polypeptide
  source 1..1735: mol_type = other DNA
atgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacgctctcttctgctgggttctctgcctggataaaagattctacggctgaacagaatcgttcaaaaaccacggtcttggccaggcgcagtggctcacacctaaaatcccagcactttgggaggccgaagtgggcggatcacgaggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3044 - DNA, 577 bp, synthetic construct
  misc_feature 1..577: note = Synthetic polypeptide
  source 1..577: mol_type = other DNA
aatgtactcaagattgcccccgagtcagctatcaagttcatggcctatgaacagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3045 - DNA, 1594 bp, synthetic construct
  misc_feature 1..1594: note = Synthetic polypeptide
  source 1..1594: mol_type = other DNA
atgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3046 - DNA, 882 bp, synthetic construct
  misc_feature 1..882: note = Synthetic polypeptide
  source 1..882: mol_type = other DNA
tccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3047 - DNA, 877 bp, synthetic construct
  misc_feature 1..877: note = Synthetic polypeptide
  source 1..877: mol_type = other DNA
atgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3048 - DNA, 896 bp, synthetic construct
  misc_feature 1..896: note = Synthetic polypeptide
  source 1..896: mol_type = other DNA
gcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3049 - DNA, 319 bp, synthetic construct
  misc_feature 1..319: note = Synthetic polypeptide
  source 1..319: mol_type = other DNA
atgtggcagccggccacggagcgcctgcaggagagatttgcagacacagaagcggcacagagaaggccattgtgaagatcaaggcagaaaccggagttatggcatcataagccaaggaatgccaaggattgctggcaaccacctgatgttagaagagtcgaggacatgttcttctccagagcttttggatggtgtgtggccctgccaacctttacattttggacttccagcctccgaaatggtgagagattaaatttctgttgttttaagctacccagtttatggttatttgttacaacagccctaggtagctactaca

SEQ ID NO: 3050 - DNA, 1906 bp, synthetic construct
  misc_feature 1..1906: note = Synthetic polypeptide
  source 1..1906: mol_type = other DNA
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtcttaatttaaatgccgcttcctcaaagaagacttccatgatttcctcttctcaatgttacccctttattatcttggagcatcctgatttctccttcacagcacatttaaaaatttataattatatggttaaactatctgtttctctcacttaattataggctcaaatggaataaaattattgtcaatttttttgcatacttttcttctttttctatcactactgtatgcctaacaccttacacagtcccagcacattgacctttaataaatattatttgttaaatgaataaat

SEQ ID NO: 3051 - DNA, 1900 bp, synthetic construct
  misc_feature 1..1900: note = Synthetic polypeptide
  source 1..1900: mol_type = other DNA
atgtttcgacagttttatctctggacatgtttagcttcagggatcatcctgggctctctctttgaaatctgcttgggccagtatgatgatggctggaggtacatgtattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtcttaatttaaatgccgcttcctcaaagaagacttccatgatttcctcttctcaatgttacccctttattatcttggagcatcctgatttctccttcacagcacatttaaaaatttataattatatggttaaactatctgtttctctcacttaattataggctcaaatggaataaaattattgtcaatttttttgcatacttttcttctttttctatcactactgtatgcctaacaccttacacagtcccagcacattgacctttaataaatattatttgttaaatgaataaat

SEQ ID NO: 3052 - DNA, 1885 bp, synthetic construct
  misc_feature 1..1885: note = Synthetic polypeptide
  source 1..1885: mol_type = other DNA
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtcttaatttaaatgccgcttcctcaaagaagacttccatgatttcctcttctcaatgttacccctttattatcttggagcatcctgatttctccttcacagcacatttaaaaatttataattatatggttaaactatctgtttctctcacttaattataggctcaaatggaataaaattattgtcaatttttttgcatacttttcttctttttctatcactactgtatgcctaacaccttacacagtcccagcacattgacctttaataaatattatttgttaaatgaataaat

SEQ ID NO: 3053 - DNA, 718 bp, synthetic construct
  misc_feature 1..718: note = Synthetic polypeptide
  source 1..718: mol_type = other DNA
atgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtcttaatttaaatgccgcttcctcaaagaagacttccatgatttcctcttctcaatgttacccctttattatcttggagcatcctgatttctccttcacagcacatttaaaaatttataattatatggttaaactatctgtttctctcacttaattataggctcaaatggaataaaattattgtcaatttttttgcatacttttcttctttttctatcactactgtatgcctaacaccttacacagtcccagcacattgacctttaataaatattatttgttaaatgaataaat

SEQ ID NO: 3054 - DNA, 1774 bp, synthetic construct
  misc_feature 1..1774: note = Synthetic polypeptide
  source 1..1774: mol_type = other DNA
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccggaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtcttaatttaaatgccgcttcctcaaagaagacttccatgatttcctcttctcaatgttacccctttattatcttggagcatcctgatttctccttcacagcacatttaaaaatttataattatatggttaaactatctgtttctctcacttaattataggctcaaatggaataaaattattgtcaatttttttgcatacttttcttctttttctatcactactgtatgcctaacaccttacacagtcccagcacattgacctttaataaatattatttgttaaatgaataaat

SEQ ID NO: 3055 - DNA, 1819 bp, synthetic construct
  misc_feature 1..1819: note = Synthetic polypeptide
  source 1..1819: mol_type = other DNA
atgtttcgacagttttatctctggacatgtttagcttcagggatcatcctgggctctctctttgaaatctgcttgggccagtatgatgatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtcttaatttaaatgccgcttcctcaaagaagacttccatgatttcctcttctcaatgttacccctttattatcttggagcatcctgatttctccttcacagcacatttaaaaatttataattatatggttaaactatctgtttctctcacttaattataggctcaaatggaataaaattattgtcaatttttttgcatacttttcttctttttctatcactactgtatgcctaacaccttacacagtcccagcacattgacctttaataaatattatttgttaaatgaataaat

SEQ ID NO: 3056 - DNA, 217 bp, synthetic construct
  misc_feature 1..217: note = Synthetic polypeptide
  source 1..217: mol_type = other DNA
atggccgggggtgctggcgccggtgcggacggcggtgctggtggcggcggcggcggaggcgacggcagcggtcccagcggcagcagcagcggcgggaggagcctccgggaaatctgcttttgttcatgcatgcagcagacttggagaagctgatttgtcaccacctccagtagtagagttccattagttcaaaccagtcaaatcatggcatttccct

SEQ ID NO: 3057 - DNA, 661 bp, synthetic construct; identical to SEQ ID NO: 2696
  misc_feature 1..661: note = Synthetic polypeptide
  source 1..661: mol_type = other DNA

SEQ ID NO: 3058 - DNA, 786 bp, synthetic construct; identical to SEQ ID NO: 2697
  misc_feature 1..786: note = Synthetic polypeptide
  source 1..786: mol_type = other DNA

SEQ ID NO: 3059 - DNA, 757 bp, synthetic construct; identical to SEQ ID NO: 2698
  misc_feature 1..757: note = Synthetic polypeptide
  source 1..757: mol_type = other DNA

SEQ ID NO: 3060 - DNA, 432 bp, synthetic construct; identical to SEQ ID NO: 2699
  misc_feature 1..432: note = Synthetic polypeptide
  source 1..432: mol_type = other DNA

SEQ ID NO: 3061 - DNA, 385 bp, synthetic construct; identical to SEQ ID NO: 2700
  misc_feature 1..385: note = Synthetic polypeptide
  source 1..385: mol_type = other DNA

SEQ ID NO: 3062 - DNA, 5958 bp, synthetic construct; identical to SEQ ID NO: 2260
  misc_feature 1..5958: note = Synthetic polypeptide
  source 1..5958: mol_type = other DNA

SEQ ID NO: 3063 - DNA, 5904 bp, synthetic construct; identical to SEQ ID NO: 2261
  misc_feature 1..5904: note = Synthetic polypeptide
  source 1..5904: mol_type = other DNA

SEQ ID NO: 3064 - DNA, 4677 bp, synthetic construct; identical to SEQ ID NO: 2262
  misc_feature 1..4677: note = Synthetic polypeptide
  source 1..4677: mol_type = other DNA

SEQ ID NO: 3065 - DNA, 6018 bp, synthetic construct; identical to SEQ ID NO: 2263
  misc_feature 1..6018: note = Synthetic polypeptide
  source 1..6018: mol_type = other DNA

SEQ ID NO: 3066 - DNA, 6021 bp, synthetic construct; identical to SEQ ID NO: 2264
  misc_feature 1..6021: note = Synthetic polypeptide
  source 1..6021: mol_type = other DNA

SEQ ID NO: 3067 - DNA, 628 bp, synthetic construct; identical to SEQ ID NO: 2222
  misc_feature 1..628: note = Synthetic polypeptide
  source 1..628: mol_type = other DNA

SEQ ID NO: 3068 - DNA, 307 bp, synthetic construct
  misc_feature 1..307: note = Synthetic polypeptide
  source 1..307: mol_type = other DNA
atgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagatttgtgcagattgaaggagatcaacttggaaagtgcttagcataaggcctggcatagagtaagtacccgataaatgagagctattatt

SEQ ID NO: 3069 - DNA, 100 bp, synthetic construct
  misc_feature 1..100: note = Synthetic polypeptide
  source 1..100: mol_type = other DNA
atgacctatagatttgtgcagattgaaggagatcaacttggaaagtgcttagcataaggcctggcatagagtaagtacccgataaatgagagctattatt

SEQ ID NO: 3070 - DNA, 337 bp, synthetic construct
  misc_feature 1..337: note = Synthetic polypeptide
  source 1..337: mol_type = other DNA
atgtgctgcagtacccatctctttcagcctctccagctagctggcggcttggagtggccatggagtaacttgctttgtttcctgacacctgttaagctacatcctgaagtgtggggattatttccaaaccagcagtcacaggaacatgctgcttttagatttgctttgtcgcaactcacagagcccccgaagctgctcccccagattgatattgtgaacatcagcgacagctttgagatgacctatagatttgtgcagattgaaggagatcaacttggaaagtgcttagcataaggcctggcatagagtaagtacccgataaatgagagctattatt

SEQ ID NO: 3071 - DNA, 645 bp, synthetic construct; identical to SEQ ID NO: 137
  misc_feature 1..645: note = Synthetic polypeptide
  source 1..645: mol_type = other DNA

SEQ ID NO: 3072 - DNA, 2160 bp, synthetic construct
  misc_feature 1..2160: note = Synthetic polypeptide
  source 1..2160: mol_type = other DNA
atggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcagttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggccaggtgcagtggctcatgcctgtaatcccagcactttgggaggccgaggcaggcagatcacctgaggttgggagttcaagaccagcctgaccaacatggagaaagcctgtccctactaaaaatataaaattagccaggtgtggtggcgggcacctgtaatcccagctactcgggaggctgaggcagaagaatcgtttgaacccaggaggcagaggttgcggtgagctgagattgtgccactgcactccagtctgggcaacaagagcgaaacttcatctcaaaaaaaaaaaaaaaaaaaaaaaaaa

SEQ ID NO: 3073 - DNA, 1338 bp, synthetic construct
  misc_feature 1..1338: note = Synthetic polypeptide
  source 1..1338: mol_type = other DNA
atggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggccaggtgcagtggctcatgcctgtaatcccagcactttgggaggccgaggcaggcagatcacctgaggttgggagttcaagaccagcctgaccaacatggagaaagcctgtccctactaaaaatataaaattagccaggtgtggtggcgggcacctgtaatcccagctactcgggaggctgaggcagaagaatcgtttgaacccaggaggcagaggttgcggtgagctgagattgtgccactgcactccagtctgggcaacaagagcgaaacttcatctcaaaaaaaaaaaaaaaaaaaaaaaaaa

SEQ ID NO: 3074 - DNA, 2849 bp, synthetic construct; identical to SEQ ID NO: 1326
  misc_feature 1..2849: note = Synthetic polypeptide
  source 1..2849: mol_type = other DNA

SEQ ID NO: 3075 - DNA, 1925 bp, synthetic construct; identical to SEQ ID NO: 1327
  misc_feature 1..1925: note = Synthetic polypeptide
  source 1..1925: mol_type = other DNA

SEQ ID NO: 3076 - DNA, 2729 bp, synthetic construct; identical to SEQ ID NO: 1328
  misc_feature 1..2729: note = Synthetic polypeptide
  source 1..2729: mol_type = other DNA

SEQ ID NO: 3077 - DNA, 2549 bp, synthetic construct; identical to SEQ ID NO: 1329
  misc_feature 1..2549: note = Synthetic polypeptide
  source 1..2549: mol_type = other DNA

SEQ ID NO: 3078 - DNA, 1065 bp, synthetic construct
  misc_feature 1..1065: note = Synthetic polypeptide
  source 1..1065: mol_type = other DNA
atggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagaa

SEQ ID NO: 3079 - DNA, 3057 bp, synthetic construct
  misc_feature 1..3057: note = Synthetic polypeptide
  source 1..3057: mol_type = other DNA
atgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtgaatggacagctgctcccttagac

SEQ ID NO: 3080 - DNA, 3024 bp, synthetic construct
  misc_feature 1..3024: note = Synthetic polypeptide
  source 1..3024: mol_type = other DNA
atgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaacctcctcatcttcatctatgatgaggtccgaaagctcatcctgcggcggtatcctggtgaatggacagctgctcccttagac

SEQ ID NO: 3081 - DNA, 2138 bp, synthetic construct
  misc_feature 1..2138: note = Synthetic polypeptide
  source 1..2138: mol_type = other DNA
tccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtgaatggacagctgctcccttagac

SEQ ID NO: 3082 - DNA, 3608 bp, synthetic construct
  misc_feature 1..3608: note = Synthetic polypeptide
  source 1..3608: mol_type = other DNA
atgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgccccactattcacaatagccaaggtgggaacatccaaaatacccatcaacagatgaaggaagagacaaaatgtggtccatccatgcaatggaatattgttcggccataaaggagaa

SEQ ID NO: 3083 - DNA, 1961 bp, synthetic construct
  misc_feature 1..1961: note = Synthetic polypeptide
  source 1..1961: mol_type = other DNA
atgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgccccactattcacaatagccaaggtgggaacatccaaaatacccatcaacagatgaaggaagagacaaaatgtggtccatccatgcaatggaatattgttcggccataaaggagaa

SEQ ID NO: 3084 - DNA, 352 bp, synthetic construct
  misc_feature 1..352: note = Synthetic polypeptide
  source 1..352: mol_type = other DNA
agggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgccccactattcacaatagccaaggtgggaacatccaaaatacccatcaacagatgaaggaagagacaaaatgtggtccatccatgcaatggaatattgttcggccataaaggagaa

SEQ ID NO: 3085 - DNA, 1030 bp, synthetic construct; identical to SEQ ID NO: 2232
  misc_feature 1..1030: note = Synthetic polypeptide
  source 1..1030: mol_type = other DNA

SEQ ID NO: 3086 - DNA, 1204 bp, synthetic construct; identical to SEQ ID NO: 2233
  misc_feature 1..1204: note = Synthetic polypeptide
  source 1..1204: mol_type = other DNA

SEQ ID NO: 3087 - DNA, 519 bp, synthetic construct
  misc_feature 1..519: note = Synthetic polypeptide
  source 1..519: mol_type = other DNA
atggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctgggcctcaatcttcccagccctaaaacaggggtctgga

SEQ ID NO: 3088 - DNA, 522 bp, synthetic construct
  misc_feature 1..522: note = Synthetic polypeptide
  source 1..522: mol_type = other DNA
atgttgaccttagagtttgggattctggaattcgatccttcatggataggcagctggacacagaggtcgtgggtgagctggaggagcaggcccggatgtgagctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctgggcctcaatcttcccagccctaaaacaggggtctgga

SEQ ID NO: 3089 - DNA, 353 bp, synthetic construct; identical to SEQ ID NO: 2268
  misc_feature 1..353: note = Synthetic polypeptide
  source 1..353: mol_type = other DNA

SEQ ID NO: 3090 - DNA, 340 bp, synthetic construct; identical to SEQ ID NO: 2269
  misc_feature 1..340: note = Synthetic polypeptide
  source 1..340: mol_type = other DNA

SEQ ID NO: 3091 - DNA, 362 bp, synthetic construct; identical to SEQ ID NO: 2270
  misc_feature 1..362: note = Synthetic polypeptide
  source 1..362: mol_type = other DNA

SEQ ID NO: 3092 - DNA, 550 bp, synthetic construct
  misc_feature 1..550: note = Synthetic polypeptide
  source 1..550: mol_type = other DNA
atggagccgctcagccaccggggcctgccgcgcctgtcctggatcgacaccctctacagcaacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctgggggtgcggtggctcacacctgtaatcccagcactttgggaggccaaggcgggcggatcacgaggtcaggagatcgagaccatcctggctaacacggtgaaatcccggctctactaaaaatacaaaaagttagctgggcgtggtggcgggagcctgtagtcccagctactcgggaggctgaggcaggagaatggcgtgaacccgggaggcggagcttgcagtgagccgagatcgcgccactgcactctagcctgggcgacagagcgagactccgtctctaaaaaaaaaaaaaaaagaaaaaataaa

SEQ ID NO: 3093 - DNA, 412 bp, synthetic construct
  misc_feature 1..412: note = Synthetic polypeptide
  source 1..412: mol_type = other DNA
atgccgtacatcgatgagtcgcccaccatgtccccgcagctcagcgcccgcagccagggcgggggggatggcgtctccccgactccacctgagggactggctcctgggggtgcggtggctcacacctgtaatcccagcactttgggaggccaaggcgggcggatcacgaggtcaggagatcgagaccatcctggctaacacggtgaaatcccggctctactaaaaatacaaaaagttagctgggcgtggtggcgggagcctgtagtcccagctactcgggaggctgaggcaggagaatggcgtgaacccgggaggcggagcttgcagtgagccgagatcgcgccactgcactctagcctgggcgacagagcgagactccgtctctaaaaaaaaaaaaaaaagaaaaaataaa

SEQ ID NO: 3094 - DNA, 4120 bp, synthetic construct; identical to SEQ ID NO: 1356
  misc_feature 1..4120: note = Synthetic polypeptide
  source 1..4120: mol_type = other DNA

SEQ ID NO: 3095 - DNA, 4132 bp, synthetic construct; identical to SEQ ID NO: 1357
  misc_feature 1..4132: note = Synthetic polypeptide
  source 1..4132: mol_type = other DNA

SEQ ID NO: 3096 - DNA, 4120 bp, synthetic construct; identical to SEQ ID NO: 1358
  misc_feature 1..4120: note = Synthetic polypeptide
  source 1..4120: mol_type = other DNA

SEQ ID NO: 3097 - DNA, 4024 bp, synthetic construct; identical to SEQ ID NO: 1359
  misc_feature 1..4024: note = Synthetic polypeptide
  source 1..4024: mol_type = other DNA

SEQ ID NO: 3098 - DNA, 4531 bp, synthetic construct; identical to SEQ ID NO: 1360
  misc_feature 1..4531: note = Synthetic polypeptide
  source 1..4531: mol_type = other DNA

SEQ ID NO: 3099 - DNA, 4054 bp, synthetic construct; identical to SEQ ID NO: 1361
  misc_feature 1..4054: note = Synthetic polypeptide
  source 1..4054: mol_type = other DNA

SEQ ID NO: 3100 - DNA, 4078 bp, synthetic construct; identical to SEQ ID NO: 1362
  misc_feature 1..4078: note = Synthetic polypeptide
  source 1..4078: mol_type = other DNA

SEQ ID NO: 3101 - DNA, 4201 bp, synthetic construct; identical to SEQ ID NO: 1363
  misc_feature 1..4201: note = Synthetic polypeptide
  source 1..4201: mol_type = other DNA

SEQ ID NO: 3102 - DNA, 4189 bp, synthetic construct; identical to SEQ ID NO: 1364
  misc_feature 1..4189: note = Synthetic polypeptide
  source 1..4189: mol_type = other DNA

SEQ ID NO: 3103 - DNA, 210 bp, synthetic construct; identical to SEQ ID NO: 1365
  misc_feature 1..210: note = Synthetic polypeptide
  source 1..210: mol_type = other DNA

SEQ ID NO: 3104 - DNA, 970 bp, synthetic construct
  misc_feature 1..970: note = Synthetic polypeptide
  source 1..970: mol_type = other DNA
atgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagctactcaggaggtggaggcaggagaatcacttgaaccttggaggcggaggctgcagtgagccgggagtgcgccacggcacttcagcctgggcgacagagcgagactctgtctcaaaagagaaaa

SEQ ID NO: 3105 - DNA, 871 bp, synthetic construct
  misc_feature 1..871: note = Synthetic polypeptide
  source 1..871: mol_type = other DNA
atgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagctactcaggaggtggaggcaggagaatcacttgaaccttggaggcggaggctgcagtgagccgggagtgcgccacggcacttcagcctgggcgacagagcgagactctgtctcaaaagagaaaa

SEQ ID NO: 3106 - DNA, 628 bp, synthetic construct
  misc_feature 1..628: note = Synthetic polypeptide
  source 1..628: mol_type = other DNA
atggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggccgggcacggtggctcacacctgtaatcccagcactttgggaggccgagacgggtggatcacgaggtcaggagatcgagaccatcctggctaacacggtgaaaccccgtctctactaaaagtacaaaaaaattagctgggcgtggtggcaggcacctgtagtcctagctacttggcaggctgaagcaggagaatggcgtgaacctgggaggcagagcttgcagtaagccgagatcgcgccactgcactccagcctcagcaacggagcaagactccacctcaaaaataaataaataaataaatgaataaaaaataaaaataaaaaataaa

SEQ ID NO: 3107 - DNA, 412 bp, synthetic construct
  misc_feature 1..412: note = Synthetic polypeptide
  source 1..412: mol_type = other DNA
atggatgaggatgccctcagccgggacgacgttatcggaaaggtctgccttacaagggacaccatagcctctcaccctaagggccgggcacggtggctcacacctgtaatcccagcactttgggaggccgagacgggtggatcacgaggtcaggagatcgagaccatcctggctaacacggtgaaaccccgtctctactaaaagtacaaaaaaattagctgggcgtggtggcaggcacctgtagtcctagctacttggcaggctgaagcaggagaatggcgtgaacctgggaggcagagcttgcagtaagccgagatcgcgccactgcactccagcctcagcaacggagcaagactccacctcaaaaataaataaataaataaatgaataaaaaataaaaataaaaaataaa

SEQ ID NO: 3108 - DNA, 571 bp, synthetic construct
  misc_feature 1..571: note = Synthetic polypeptide
  source 1..571: mol_type = other DNA
atggccaagcgcagctcgctgtacatccgcatcgtggaggggaagaaccttcccgccaaggacatgacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggccgggcacggtggctcacacctgtaatcccagcactttgggaggccgagacgggtggatcacgaggtcaggagatcgagaccatcctggctaacacggtgaaaccccgtctctactaaaagtacaaaaaaattagctgggcgtggtggcaggcacctgtagtcctagctacttggcaggctgaagcaggagaatggcgtgaacctgggaggcagagcttgcagtaagccgagatcgcgccactgcactccagcctcagcaacggagcaagactccacctcaaaaataaataaataaataaatgaataaaaaataaaaataaaaaataaa

SEQ ID NO: 3109 - DNA, 268 bp, synthetic construct
  misc_feature 1..268: note = Synthetic polypeptide
  source 1..268: mol_type = other DNA
ctgcgcagaggggcccggggaaagccggcctcacgggcgggagggagaggcttgagcgaggggctagagccgcgaggactgaccagcaccagaggatacaagaggaggagagagacctcactggttcgggcgacatttcacccccccagcaccccagtcggcacagcttctcacctggggcgggtgggttctgcaccaccctcccaccctccttcctccgtgtggacgatagagccacatccagcaccacggacagctcccgggcgaa

SEQ ID NO: 3110 - DNA, 215 bp, synthetic construct
  misc_feature 1..215: note = Synthetic polypeptide
  source 1..215: mol_type = other DNA
gggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgaa

SEQ ID NO: 3111 - DNA, 173 bp, synthetic construct
  misc_feature 1..173: note = Synthetic polypeptide
  source 1..173: mol_type = other DNA
atgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgaa

SEQ ID NO: 3112 - DNA, 212 bp, synthetic construct
  misc_feature 1..212: note = Synthetic polypeptide
  source 1..212: mol_type = other DNA
ccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgaa

SEQ ID NO: 3113 - DNA, 3220 bp, synthetic construct; identical to SEQ ID NO: 248
  misc_feature 1..3220: note = Synthetic polypeptide
  source 1..3220: mol_type = other DNA

SEQ ID NO: 3114 - DNA, 98 bp, synthetic construct
  misc_feature 1..98: note = Synthetic polypeptide
  source 1..98: mol_type = other DNA
atgaaacttctttacctgtttcttgccatccttctggccatagaagaaccagtgatatcaggattgcagtaaggatgaaatgacataataatgcaaag

SEQ ID NO: 3115 - DNA, 628 bp, synthetic construct
  misc_feature 1..628: note = Synthetic polypeptide
  source 1..628: mol_type = other DNA
atggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggccgggcacggtggctcacacctgtaatcccagcactttgggaggccgagacgggtggatcacgaggtcaggagatcgagaccatcctggctaacacggtgaaaccccgtctctactaaaagtacaaaaaaattagctgggcgtggtggcaggcacctgtagtcctagctacttggcaggctgaagcaggagaatggcgtgaacctgggaggcagagcttgcagtaagccgagatcgcgccactgcactccagcctcagcagcggagcaagactccacctcaaaaataaataaataaataaatgaataaaaaataaaaataaaaaataaa

SEQ ID NO: 3116 - DNA, 412 bp, synthetic construct
  misc_feature 1..412: note = Synthetic polypeptide
  source 1..412: mol_type = other DNA
atggatgaggatgccctcagccgggacgacgttatcggaaaggtctgccttacaagggacaccatagcctctcaccctaagggccgggcacggtggctcacacctgtaatcccagcactttgggaggccgagacgggtggatcacgaggtcaggagatcgagaccatcctggctaacacggtgaaaccccgtctctactaaaagtacaaaaaaattagctgggcgtggtggcaggcacctgtagtcctagctacttggcaggctgaagcaggagaatggcgtgaacctgggaggcagagcttgcagtaagccgagatcgcgccactgcactccagcctcagcagcggagcaagactccacctcaaaaataaataaataaataaatgaataaaaaataaaaataaaaaataaa

SEQ ID NO: 3117 - DNA, 212 bp, synthetic construct
  misc_feature 1..212: note = Synthetic polypeptide
  source 1..212: mol_type = other DNA
atgaacaagaagaagaaaccgttcctagggatgcccgcgcccctcggctacgtgccggggctgggccgggggaagcaacgggctttggggtcaggacatacctgtgtgtgcaccctgcttgccgcctagatgtgacacattgactctcagcccagtgttttggtctgtaagatgggtaatgctgtatacggtctgcagtgaggagtagagga

SEQ ID NO: 3118 - DNA, 1898 bp, synthetic construct; identical to SEQ ID NO: 2282
  misc_feature 1..1898: note = Synthetic polypeptide
  source 1..1898: mol_type = other DNA

SEQ ID NO: 3119 - DNA, 1865 bp, synthetic construct; identical to SEQ ID NO: 2283
  misc_feature 1..1865: note = Synthetic polypeptide
  source 1..1865: mol_type = other DNA

SEQ ID NO: 3120 - DNA, 764 bp, synthetic construct; identical to SEQ ID NO: 2284
  misc_feature 1..764: note = Synthetic polypeptide
  source 1..764: mol_type = other DNA

SEQ ID NO: 3121 - DNA, 978 bp, synthetic construct; identical to SEQ ID NO: 2267
  misc_feature 1..978: note = Synthetic polypeptide
  source 1..978: mol_type = other DNA

SEQ ID NO: 3122 - DNA, 1109 bp, synthetic construct
  misc_feature 1..1109: note = Synthetic polypeptide
  source 1..1109: mol_type = other DNA
atgggccgggcccggcgcttccagtggccgctgctgctgctgtgggcggccgcggcggggccaggggcaggacaggaagtacagacagagaacgtgacagtggctgagggtggggtggctgagatcacctgccgtctgcaccagtatgatgggtccatagttgtcatccagaacccagcccggcagaccctcttcttcaatggcacccgtgccttgaaggatgagcgtttccagcttgaggagttctccccacgccgggtgcggatccggctctcagatgcccgcctggaggacgaggggggctatttctgccagctctacacagaagacacccaccaccagattgccacgctcacggtactagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggagtgagcagcagccaggaaaatggcaaggtctggagcgtggcaagcacagtacggtttcgtgtggaccgtaaggacgacggtggtatcatcatctgtgaggcgcagaaccaggcgctgccctccggacacagcaagcagacgcagtacgtgctggatgtgcagtactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacgactggcccgcggggctcaaattcgggttggctgcattctattgcaggtaaccgaacctgtctgcgcctcagtttacccatcagtaaagtggaaataaacaatagcacctatataacaaggctgttgtgaagattatgtgaactaaatatgtaaggtggttggaatgggctctagcacacag

SEQ ID NO: 3123 - DNA, 2397 bp, synthetic construct
  misc_feature 1..2397: note = Synthetic polypeptide
  source 1..2397: mol_type = other DNA
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3124 - DNA, 2391 bp, synthetic construct
  misc_feature 1..2391: note = Synthetic polypeptide
  source 1..2391: mol_type = other DNA
atgtttcgacagttttatctctggacatgtttagcttcagggatcatcctgggctctctctttgaaatctgcttgggccagtatgatgatggctggaggtacatgtattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3125 - DNA, 2376 bp, synthetic construct
  misc_feature 1..2376: note = Synthetic polypeptide
  source 1..2376: mol_type = other DNA
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3126 - DNA, 1209 bp, synthetic construct
  misc_feature 1..1209: note = Synthetic polypeptide
  source 1..1209: mol_type = other DNA
atgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3127 - DNA, 2265 bp, synthetic construct
  misc_feature 1..2265: note = Synthetic polypeptide
  source 1..2265: mol_type = other DNA
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccggaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3128 - DNA, 2310 bp, synthetic construct
  misc_feature 1..2310: note = Synthetic polypeptide
  source 1..2310: mol_type = other DNA
atgtttcgacagttttatctctggacatgtttagcttcagggatcatcctgggctctctctttgaaatctgcttgggccagtatgatgatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3129 - DNA, 2163 bp, synthetic construct
  misc_feature 1..2163: note = Synthetic polypeptide
  source 1..2163: mol_type = other DNA
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaagcacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3130 - DNA, 404 bp, synthetic construct
  misc_feature 1..404: note = Synthetic polypeptide
  source 1..404: mol_type = other DNA
atggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagaacgtggctttcatcagaatctcaaaggcgaccaagatcccaacaa

SEQ ID NO: 3131 - DNA, 422 bp, synthetic construct
  misc_feature 1..422: note = Synthetic polypeptide
  source 1..422: mol_type = other DNA
atggcaggacgaagatcttcccagccaggaattgctttgcacaatcctgggaaccaccaagtccaaaatccacagggcaggctggaaactgtcaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagaacgtggctttcatcagaatctcaaaggcgaccaagatcccaacaa

SEQ ID NO: 3132 - DNA, 2927 bp, synthetic construct
  misc_feature 1..2927: note = Synthetic polypeptide
  source 1..2927: mol_type = other DNA
atgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagagggatg

SEQ ID NO: 3133 - DNA, 2930 bp, synthetic construct
  misc_feature 1..2930: note = Synthetic polypeptide
  source 1..2930: mol_type = other DNA
atgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagagggatg

SEQ ID NO: 3134 - DNA, 175 bp, synthetic construct
  misc_feature 1..175: note = Synthetic polypeptide
  source 1..175: mol_type = other DNA
actgtgatgactcattcaccccccaggagaagctgtggcagcagctcagaagaggacgggagtggaggaggagaaagtaaagaaaagcaaggaaggagggagaatgaaaaagtgctgggaggaagaaggagaaacgagagagaagaggtggagaacaggacagaaaaagaggaga

SEQ ID NO: 3135 - DNA, 1289 bp, synthetic construct
  misc_feature 1..1289: note = Synthetic polypeptide
  source 1..1289: mol_type = other DNA
atggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacaggtagacgggggcgccaacttttctgtggaccggtgggagaggaaggaaggaggtggcggcatcagctgtgtacttcaagatgggtgtgttttcgaaaaggctggggtgagcatttctgttgttcatggaaatctttcagaggaagctgcaaaacaaatgagaagcagaggaaaagttctgaagactaaagatggtaaattgccattttgtgctatgggcgtgagctctgttatccaccccaagaatcctcatgctcctactatccatttcaactacagatactttgaagtagaagaagctgatggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtgtgatgattacttctttatagcccatcgtggagaacggcggggcattggtggtatcttttttgatgatcttgactctccgtccaaggaggaggtgtttcgctttgtacagagctgtgccagggctgtagttccttcttacattccccttgtgaaaaagcactgtgatgactcattcaccccccaggagaagctgtggcagcagctcagaagaggacgggagtggaggaggagaaagtaaagaaaagcaaggaaggagggagaatgaaaaagtgctgggaggaagaaggagaaacgagagagaagaggtggagaacaggacagaaaaagaggaga

SEQ ID NO: 3136 - DNA, 18530 bp, synthetic construct
  misc_feature 1..18530: note = Synthetic polypeptide
  source 1..18530: mol_type = other DNA
atgtcggtgttcctggggccagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttgacagtactcgatgacgaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagacagggttaacgtggaaaaccaagtgctgaaatctggatatactagccgtgacctaattattttggaaaatgatgaccctgggggagtttttgaattttctcctgcttccagaggaccctatgttataaaagaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtgctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgagattccagaagaaatggaagaatttaccgttatcctactgaatggcactggaggagctaaagtgggaaatagaacaactgcaactctgaggattagaagaaatgatgaccccatttattttgcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtgatacagtagtatatcaatatggagtagctacagtaataattgaagctaatgatgacccaaatggcattttttctctggagcccatagacaaagcagtggaagaaggaaagactaatgcattttggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagtagctgaactctttagggttgatggaagtggtagtggtgatggggacatggaattcttccttccaactattcacaaacgtgccagtctaggagtggcttcccaaattctagtgacaattgcagcctctgaccacgctcatggcgtatttgaatttagccctgagtcactctttgtcagtggaactgaaccagaagatgggtatagcactgttacattaaatgttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaattccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatggcattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagaggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgagactgagtcccagaagaccattgtgttgcacacacttcaagacacagtgttggaggaggacaggcgtttcaccattcagctgatatcaattgatgaggtagaaatatctccagtaaaaggtagtgcatcaataattattcggggtgataagcgagcatcaggagaagttgggatagctccgtcatctaggcacatcctcattggggaaccctcagcaaaatataatggtaccgctattatcagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcaggcaaattatgtaatttctctgaaatgaggatagcactacttactttacaaggcacctatggaaatcaaccaaagaatgtgaaatttccagcacttaac

SEQ ID NO: 3137 - DNA, 5513 bp, synthetic construct
  misc_feature 1..5513: note = Synthetic polypeptide
  source 1..5513: mol_type = other DNA
atgcaattatgtattttttgttgttgttgtattttattttattttgatttgtatgactttggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcaggcaaattatgtaatttctctgaaatgaggatagcactacttactttacaaggcacctatggaaatcaaccaaagaatgtgaaatttccagcacttaac

SEQ ID NO: 3138 - DNA, 520 bp, synthetic construct; identical to SEQ ID NO: 1727
  misc_feature 1..520: note = Synthetic polypeptide
  source 1..520: mol_type = other DNA

SEQ ID NO: 3139 - DNA, 403 bp, synthetic construct; identical to SEQ ID NO: 2317
  misc_feature 1..403: note = Synthetic polypeptide
  source 1..403: mol_type = other DNA

SEQ ID NO: 3140 - DNA, 688 bp, synthetic construct; identical to SEQ ID NO: 2318
  misc_feature 1..688: note = Synthetic polypeptide
  source 1..688: mol_type = other DNA

SEQ ID NO: 3141 - DNA, 757 bp, synthetic construct; identical to SEQ ID NO: 2319
  misc_feature 1..757: note = Synthetic polypeptide
  source 1..757: mol_type = other DNA

SEQ ID NO: 3142 - DNA, 547 bp, synthetic construct; identical to SEQ ID NO: 2320
  misc_feature 1..547: note = Synthetic polypeptide
  source 1..547: mol_type = other DNA

SEQ ID NO: 3143 - DNA, 256 bp, synthetic construct; identical to SEQ ID NO: 2321
  misc_feature 1..256: note = Synthetic polypeptide
  source 1..256: mol_type = other DNA

SEQ ID NO: 3144 - DNA, 622 bp, synthetic construct; identical to SEQ ID NO: 2322
  misc_feature 1..622: note = Synthetic polypeptide
  source 1..622: mol_type = other DNA

SEQ ID NO: 3145 - DNA, 343 bp, synthetic construct; identical to SEQ ID NO: 2323
  misc_feature 1..343: note = Synthetic polypeptide
  source 1..343: mol_type = other DNA

SEQ ID NO: 3146 - DNA, 511 bp, synthetic construct
  misc_feature 1..511: note = Synthetic polypeptide
  source 1..511: mol_type = other DNA
atggaggaggccggagcagcggtggtcacggccggggaggccgaactgaactggtcccgcctcagcgtgtccaccgagacgctggagtctgagctggaggcgcggggggaggagcggcgcggggcgcgggaggcgctgctgcggctgctgctgcctcacaaccgtctggtgtcgctgccacgggcgctgggcagcggcttcccgcacctccagctgctggacgtgagcggcaacgcgttgaccgcgctcgggccggagctgctcgctctgcgcggcctgcgcacgctgctggccaagaacaaccggctcggcgggcccagtgcgctgcccaagggcctggcccagtcgccgctctgccgcagcctccaggtgctcaacctcagcggcaactgtttccaggaggtgcctgcctcgctcttagagctgcgcgcgctgcagaccctgagcctgggcggcaaccaactgcagagcatcccggctgagatcgagaacttgcagagcttcctcttct

SEQ ID NO: 3147 - DNA, 1004 bp, synthetic construct
  misc_feature 1..1004: note = Synthetic polypeptide
  source 1..1004: mol_type = other DNA
atgctgagcggagcggctggggctgcgcggcgtggcggagcagcgctcgctccctcgctcactcgctcgctcgcagggacacacgcaggggctgacagctgtgctggtgctgataagggaagccacaaggagacgatcgaggagagagacaagcggcagcagaggcagcagcggcagaggcagcaccagggctgcggagctgctgggagtgggagtgactcccccacctcgggcccccaccctgtccctgtcctcttcccgcttgccctgagtttagaagagcagccgctgccaccactgccactcgggagggcaccagggctgctggctagggagggacagggcagggaggctctggccagtcccagcagccggggacagatgccgatcgagattgtgtgcaaaatcaaatttgctgaggaggatgcgaaacccaaggagaaggaggcaggggatgagcagagcctcctcggggctgttgcccctggagcagccccccgagacctggccacctttgccagcaccagcaccctgcatggactgggccgggcctgtggcccaggcccccacggactgcgcagaaccctgtgggcactggccctactcacctcgctggctgccttcctgtaccaggcggctggcctggcccggggctacctgacccggcctcacctggtggcaatggaccccgctgccccagccccagtggcgggcttcccggctgtcaccctctgcaatatcaaccgcttccggcattcggcactcagcgatgccgacatcttccacctggccaatctgacagggctgccccccaaagaccgggatgggcaccgtgcggctggcctgcgctacccagagcctgacatggtagacatcctcaaccgcactggccaccagctcgccgacatgcttaagagctgcaacttcagtgggcatcactgctccgccagcaacttctctgtggcttcatttcttgagctgtaaaatgcaagggtggctctaaa

SEQ ID NO: 3148 - DNA, 646 bp, synthetic construct
  misc_feature 1..646: note = Synthetic polypeptide
  source 1..646: mol_type = other DNA
atgatgaaacgggcagctgctgctgcagtgggaggagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggacagctgaggttgcaggggcaccagatggcctgaacgcaggacagtcaggtgcctccagggagagacaggactctggatcactgagccccctggggtccattgcacaagcgagtaaggaatcagctaaaagtcttaagtgattgctaaaggccaactaagactcacgtgagtgcatagaaccttcagaagccacagagacaacatggatcctaccaacatgcagacctttttccctgcggactgggtccctgcagggtcctgaagaaagcttccctggaaggggcaagactggaggaag

SEQ ID NO: 3149 - DNA, 571 bp, synthetic construct
  misc_feature 1..571: note = Synthetic polypeptide
  source 1..571: mol_type = other DNA
atgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggacagctgaggttgcaggggcaccagatggcctgaacgcaggacagtcaggtgcctccagggagagacaggactctggatcactgagccccctggggtccattgcacaagcgagtaaggaatcagctaaaagtcttaagtgattgctaaaggccaactaagactcacgtgagtgcatagaaccttcagaagccacagagacaacatggatcctaccaacatgcagacctttttccctgcggactgggtccctgcagggtcctgaagaaagcttccctggaaggggcaagactggaggaag

SEQ ID NO: 3150 - DNA, 718 bp, synthetic construct; identical to SEQ ID NO: 1366
  misc_feature 1..718: note = Synthetic polypeptide
  source 1..718: mol_type = other DNA

SEQ ID NO: 3151 - DNA, 281 bp, synthetic construct
  misc_feature 1..281: note = Synthetic polypeptide
  source 1..281: mol_type = other DNA
atgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcggatcaagaagctgtacaaagtgcccgacttcccctcgaaacgcctgcccaactggaggaccagagggttggaacagcgccggcagggcttggaggcttacatccaggactgaaagaggtaacg

SEQ ID NO: 3152 - DNA, 2671 bp, synthetic construct
  misc_feature 1..2671: note = Synthetic polypeptide
  source 1..2671: mol_type = other DNA
atgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcctcccagccaagaagtttctgctgtcctaagcctcccggtttgtggtcctttgtcaagggcagccctagga

SEQ ID NO: 3153 - DNA, 1990 bp, synthetic construct
  misc_feature 1..1990: note = Synthetic polypeptide
  source 1..1990: mol_type = other DNA
atggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcctcccagccaagaagtttctgctgtcctaagcctcccggtttgtggtcctttgtcaagggcagccctagga

SEQ ID NO: 3154 - DNA, 262 bp, synthetic construct
  misc_feature 1..262: note = Synthetic polypeptide
  source 1..262: mol_type = other DNA
atgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcctcccagccaagaagtttctgctgtcctaagcctcccggtttgtggtcctttgtcaagggcagccctagga

SEQ ID NO: 3155 - DNA, 1563 bp, synthetic construct; identical to SEQ ID NO: 2008
  misc_feature 1..1563: note = Synthetic polypeptide
  source 1..1563: mol_type = other DNA

SEQ ID NO: 3156 - DNA, 569 bp, synthetic construct
  misc_feature 1..569: note = Synthetic polypeptide
  source 1..569: mol_type = other DNA
atgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggggccggagttaagatgagtccagcgaagtgcctagagtaccaaattcatggagacgtttcctctttggg

SEQ ID NO: 3157 - DNA, 833 bp, synthetic construct
  misc_feature 1..833: note = Synthetic polypeptide
  source 1..833: mol_type = other DNA
atggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggggccggagttaagatgagtccagcgaagtgcctagagtaccaaattcatggagacgtttcctctttggg

SEQ ID NO: 3158 - DNA, 647 bp, synthetic construct
  misc_feature 1..647: note = Synthetic polypeptide
  source 1..647: mol_type = other DNA
atggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggggccggagttaagatgagtccagcgaagtgcctagagtaccaaattcatggagacgtttcctctttggg

SEQ ID NO: 3159 - DNA, 357 bp, synthetic construct
  misc_feature 1..357: note = Synthetic polypeptide
  source 1..357: mol_type = other DNA
tatccatgagcagtgggaaaaggctaatgtaagcagtccccaccgggagttcccccctgctaccgccagagaggtggacccactccggattcctccacaccacccacacaccagtcggcagcctccctggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggggccggagttaagatgagtccagcgaagtgcctagagtaccaaattcatggagacgtttcctctttggg

SEQ ID NO: 3160 - DNA, 553 bp, synthetic construct
  misc_feature 1..553: note = Synthetic polypeptide
  source 1..553: mol_type = other DNA
atgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaaaaaatttgccaactcatg

SEQ ID NO: 3161 - DNA, 2607 bp, synthetic construct
  misc_feature 1..2607: note = Synthetic polypeptide
  source 1..2607: mol_type = other DNA
atgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttcggtggcttatgcctgtaatctcagtactttgggaggccgagctggatggatcacaaggtcaggagttcgagaccagcctggccaacatggtgaaaccccatctctactaaaaatacaaaaaattagctgggcatggtggtgtgagcctgtaatcccagctactcaggagggtgaggcaggagaattgctttaacccaggaggcagaggttgcagtgagccaagatcacaccaatgcaccccagcctgggtggcagagcaagactccatctcaaagaaaaaagaaaaaaaaaa

SEQ ID NO: 3162 - DNA, 2379 bp, synthetic construct
  misc_feature 1..2379: note = Synthetic polypeptide
  source 1..2379: mol_type = other DNA
atgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttcggtggcttatgcctgtaatctcagtactttgggaggccgagctggatggatcacaaggtcaggagttcgagaccagcctggccaacatggtgaaaccccatctctactaaaaatacaaaaaattagctgggcatggtggtgtgagcctgtaatcccagctactcaggagggtgaggcaggagaattgctttaacccaggaggcagaggttgcagtgagccaagatcacaccaatgcaccccagcctgggtggcagagcaagactccatctcaaagaaaaaagaaaaaaaaaa

SEQ ID NO: 3163 - DNA, 2460 bp, synthetic construct
  misc_feature 1..2460: note = Synthetic polypeptide
  source 1..2460: mol_type = other DNA
atgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttcggtggcttatgcctgtaatctcagtactttgggaggccgagctggatggatcacaaggtcaggagttcgagaccagcctggccaacatggtgaaaccccatctctactaaaaatacaaaaaattagctgggcatggtggtgtgagcctgtaatcccagctactcaggagggtgaggcaggagaattgctttaacccaggaggcagaggttgcagtgagccaagatcacaccaatgcaccccagcctgggtggcagagcaagactccatctcaaagaaaaaagaaaaaaaaaa

SEQ ID NO: 3164 - skipped

SEQ ID NO: 3165 - DNA, 555 bp, synthetic construct
  misc_feature 1..555: note = Synthetic polypeptide
  source 1..555: mol_type = other DNA
atgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgggtttgaactgcgcagcttcacttaaatgcatggattttcttctgcctccaccacctctgagacagcaagatcagcccctcctcctctcagcctactcaatgcaaagaagacaaggatgaagacctttatgatgatccacttccacttaatgaatagtaaatatattttctcttcttatgattttctt

SEQ ID NO: 3166 - DNA, 189 bp, synthetic construct
  misc_feature 1..189: note = Synthetic polypeptide
  source 1..189: mol_type = other DNA
atgcaggtttgcagccagccccaaagggggtgtgtgcgcgagcagagcgctataaatacggcgcctcccagtgcccacaacgcggcgtcgccaggaggagcgcgcgggcacagggtgccgctgaccggtccgtgagtaagtggagtattacatagccataaaagtatgcccttaaagaatatttgaaga

SEQ ID NO: 3167 - DNA, 2492 bp, synthetic construct
  misc_feature 1..2492: note = Synthetic polypeptide
  source 1..2492: mol_type = other DNA
atgtggctggtaactttcctcctgctcctggactctttacacaaagcccgccctgaagatgttggcaccagcctctactttgtaaatgactccttgcagcagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctgggcgtggtggcgcatgcctgtagttccagctaatcaggaggctgaggcaggagaatcgcttgaacctgggaggcagagcttgctgtgagccaagatcgcaccactgcactccagcctgggcgacagaggaagactccatctcaaaaaaaaaaaaaatgcagaaaaa

SEQ ID NO: 3168 - DNA, 3302 bp, synthetic construct
  misc_feature 1..3302: note = Synthetic polypeptide
  source 1..3302: mol_type = other DNA
atgacaggagccggggagccgaggagggaggagccgccgccgcagccgagcgctgggctgaggagcagagagagcggggcgccgagtgcgggcggctgggagcgcgctgagcgggggagaggcgctgccgcacggccggccacaggaccacctccccggagaatagggcctctttatggcatgtggctggtaactttcctcctgctcctggactctttacacaaagcccgccctgaagatgttggcaccagcctctactttgtaaatgactccttgcagcaggtgaccttttccagctccgtgggggtggtggtgccctgcccggccgcgggctcccccagcgcggcccttcgatggtacctggccacaggggacgacatctacgacgtgccgcacatccggcacgtccacgccaacgggacgctgcagctctaccccttctccccctccgccttcaatagctttatccacgacaatgactacttctgcaccgcggagaacgctgccggcaagatccggagccccaacatccgcgtcaaagcagttttcagggaaccctacaccgtccgggtggaggatcaaaggtcaatgcgtggcaacgtggccgtcttcaagtgcctcatcccctcttcagtgcaggaatatgttagcgttgtatcttgggagaaagacacagtctccatcatcccagaacacaggttttttattacctaccacggcgggctgtacatctctgacgtacagaaggaggacgccctctccacctatcgctgcatcaccaagcacaagtatagcggggagacccggcagagcaatggggcacgcctctctgtgacagaccctgctgagtcgatccccaccatcctggatggcttccactcccaggaagtgtgggccggccacaccgtggagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctgggcgtggtggcgcatgcctgtagttccagctaatcaggaggctgaggcaggagaatcgcttgaacctgggaggcagagcttgctgtgagccaagatcgcaccactgcactccagcctgggcgacagaggaagactccatctcaaaaaaaaaaaaaatgcagaaaaa

SEQ ID NO: 3169 - DNA, 1071 bp, synthetic construct; identical to SEQ ID NO: 2257
  misc_feature 1..1071: note = Synthetic polypeptide
  source 1..1071: mol_type = other DNA

SEQ ID NO: 3170 - DNA, 1122 bp, synthetic construct; identical to SEQ ID NO: 2258
  misc_feature 1..1122: note = Synthetic polypeptide
  source 1..1122: mol_type = other DNA

SEQ ID NO: 3171 - DNA, 3733 bp, synthetic construct; identical to SEQ ID NO: 2382
  misc_feature 1..3733: note = Synthetic polypeptide
  source 1..3733: mol_type = other DNA

SEQ ID NO: 3172 - DNA, 2086 bp, synthetic construct; identical to SEQ ID NO: 2383
  misc_feature 1..2086: note = Synthetic polypeptide
  source 1..2086: mol_type = other DNA

SEQ ID NO: 3173 - DNA, 477 bp, synthetic construct; identical to SEQ ID NO: 2384
  misc_feature 1..477: note = Synthetic polypeptide
  source 1..477: mol_type = other DNA

SEQ ID NO: 3174 - DNA, 382 bp, synthetic construct; identical to SEQ ID NO: 2783
  misc_feature 1..382: note = Synthetic polypeptide
  source 1..382: mol_type = other DNA

SEQ ID NO: 3175 - DNA, 475 bp, synthetic construct; identical to SEQ ID NO: 2784
  misc_feature 1..475: note = Synthetic polypeptide
  source 1..475: mol_type = other DNA

SEQ ID NO: 3176 - DNA, 511 bp, synthetic construct; identical to SEQ ID NO: 2785
  misc_feature 1..511: note = Synthetic polypeptide
  source 1..511: mol_type = other DNA

SEQ ID NO: 3177 - DNA, 1673 bp, synthetic construct; identical to SEQ ID NO: 2326
  misc_feature 1..1673: note = Synthetic polypeptide
  source 1..1673: mol_type = other DNA

SEQ ID NO: 3178 - DNA, 3049 bp, synthetic construct
  misc_feature 1..3049: note = Synthetic polypeptide
  source 1..3049: mol_type = other DNA
atgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagcaaaagccaagagcgcatatcatgacgtggtgatcggatgctgattcacagttctgtctggaagccatggatagttctaattaattttaaatggggaaatgtattcaatacttattcacaaatgtagcttgagagacaaacaattaaatgtggcctttacagaagaaaataaggaggtccttagtgagtgaaaatttggaaatcactg

SEQ ID NO: 3179 - DNA, 2130 bp, synthetic construct
  misc_feature 1..2130: note = Synthetic polypeptide
  source 1..2130: mol_type = other DNA
tccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagcaaaagccaagagcgcatatcatgacgtggtgatcggatgctgattcacagttctgtctggaagccatggatagttctaattaattttaaatggggaaatgtattcaatacttattcacaaatgtagcttgagagacaaacaattaaatgtggcctttacagaagaaaataaggaggtccttagtgagtgaaaatttggaaatcactg

SEQ ID NO: 3180 - DNA, 484 bp, synthetic construct
  misc_feature 1..484: note = Synthetic polypeptide
  source 1..484: mol_type = other DNA
atgggcgagcaccccagcccgggccccgcggtggccgcctgcgccgaggcggagcgcatcgaggagctggaacccgaggccgaggagcggctgcccgcggcgccggaggaccactggaaagtcctgtttgatcagtttgaccctgggaacacaggctacattagcacaggcaagttccggagtcttctggagagccacagctccaagctggacccgcacaaaagggaggtcctcctggctcttgccgacagccacgcggatgggcagatcggctaccaggattttgtcagcctagaagccttccttgacctctgacctccctgggactggattgggctccctcttgtgtgctcccacagcaaccatcactctgaactgtgattgctggttactaatctgtcttgagcaccaccgtatccctccctgtgcctggtaatgagcctgacacttagtagttgctcagtaaattgtgatggatggatga

SEQ ID NO: 3181 - DNA, 460 bp, synthetic construct
  misc_feature 1..460: note = Synthetic polypeptide
  source 1..460: mol_type = other DNA
atgggcgagcaccccagcccgggccccgcggtggccgcctgcgccgaggcggagcgcatcgaggagctggaacccgaggccgaggagcggctgcccgcggcgccggaggactttgaccctgggaacacaggctacattagcacaggcaagttccggagtcttctggagagccacagctccaagctggacccgcacaaaagggaggtcctcctggctcttgccgacagccacgcggatgggcagatcggctaccaggattttgtcagcctagaagccttccttgacctctgacctccctgggactggattgggctccctcttgtgtgctcccacagcaaccatcactctgaactgtgattgctggttactaatctgtcttgagcaccaccgtatccctccctgtgcctggtaatgagcctgacacttagtagttgctcagtaaattgtgatggatggatga

SEQ ID NO: 3182 - DNA, 634 bp, synthetic construct
  misc_feature 1..634: note = Synthetic polypeptide
  source 1..634: mol_type = other DNA
atgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgcatagaggtcaaaagcatggaaactggagttaaaagatgtggatttgaagcctggctgtgacacttacggactgtgtgacctggagaattaatcttcctatgctttagttgctcatctgcaaatatgcatataattgtacctgtcaggagactgttgcaaagactaaatgagctaatgtattatttagtgtctggtttacagtaagtaggccctctgtgagtgttgggtat

SEQ ID NO: 3183 - DNA, 676 bp, synthetic construct
  misc_feature 1..676: note = Synthetic polypeptide
  source 1..676: mol_type = other DNA
atgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgcatagaggtcaaaagcatggaaactggagttaaaagatgtggatttgaagcctggctgtgacacttacggactgtgtgacctggagaattaatcttcctatgctttagttgctcatctgcaaatatgcatataattgtacctgtcaggagactgttgcaaagactaaatgagctaatgtattatttagtgtctggtttacagtaagtaggccctctgtgagtgttgggtat

SEQ ID NO: 3184 - DNA, 1380 bp, synthetic construct
  misc_feature 1..1380: note = Synthetic polypeptide
  source 1..1380: mol_type = other DNA
atgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggattattcacagtagccaagatgtgcaatcaaattaagtgtccatcaacagatgaatggataaagaatatgtatcacatatgcatcatggaatactattcagccttaaaaaagagaaaatcctgtcatttgccacaacttgaatgaacctggaggacattatgctaagtgaagtaagccaggcacagaaagacaaacgctgcacgatctcacttctatgtggaatctaaaaaagttgaacgaagtagagcagaatggtggttaccagaggctggggcaggggggttgttgagagatattggtcaaagggtacaaattttcagtctgactagaggaacaagttcaagaggtctactgtaaaacatggcgatagtgactacagtcaataacaatgtattgtattcttgaaaatcactgagagagtagattttaagtgttcttaccacaaaaacataagtgtgtgaggtaatgcacatgtcacttagctcaatttaactattccaaaatttatacatatctcagaacccggtgttgtacatgataaatatatacaaattttatttgtcaattaaaaaataa

SEQ ID NO: 3185 - DNA, 332 bp, synthetic construct
  misc_feature 1..332: note = Synthetic polypeptide
  source 1..332: mol_type = other DNA
atgagcatcccactgctcctccaggacaaggtggccctcgtggagcgctatgtggccggcttcccggacctccagaggaggctgctggtcctcatggattcctggtgccagcccggctttgacatcaaggacgttgccagacaaaaatttcaagagaataagaggggagacgggagctggaacccggaagacagatgtccaggcagcgactgtcctcggaggcctgagagtgctgaacctgcaaatgcaaggagccagttggcttcggagcccccgggaggcacaggaagtggaggcccagattcctccaagaagctgggctggaaacaggg

SEQ ID NO: 3186 - DNA, 848 bp, synthetic construct
  misc_feature 1..848: note = Synthetic polypeptide
  source 1..848: mol_type = other DNA
atggacccaggagatcccgctggtgaccctgccgctggcgagcgccaccgcatgggccgggaccccctcctgctcctgcaggccctgcagaccctgtggtccacgcgggagcggaagcagctccgggaggaagcctggcgggggtttgctgccttggacgaccccctggccgggcttctggacatgctggagagctgccggggccagcggggagagggcccctccctggcggcctggatctcccaccagctgcagtgctggctacaggcacagccatgcccgagcctggcccagcacagcctgaggctgaagcagctgcaggcccgagcggtcaaagtcctcactgagagcccccccagccttgcggcaccactggccagcatcttccagctgcaggatgcagacaggagctgcctgctggcacacgtccaccgcctccaccacgagggcaggttcagagaagcagccacgctgggcgcgacgttgaagctgcagtcggagcttggcgttgaaaagatgagcatcccactgctcctccaggacaaggtggccctcgtggagcgctatgtggccggcttcccggacctccagaggaggctgctggtcctcatggattcctggtgccagcccggctttgacatcaaggacgttgccagacaaaaatttcaagagaataagaggggagacgggagctggaacccggaagacagatgtccaggcagcgactgtcctcggaggcctgagagtgctgaacctgcaaatgcaaggagccagttggcttcggagcccccgggaggcacaggaagtggaggcccagattcctccaagaagctgggctggaaacaggg

SEQ ID NO: 3187 - DNA, 241 bp, synthetic construct
  misc_feature 1..241: note = Synthetic polypeptide
  source 1..241: mol_type = other DNA
tcatggattcctggtgccagcccggctttgacatcaaggacgttgccagacaaaaatttcaagagaataagaggggagacgggagctggaacccggaagacagatgtccaggcagcgactgtcctcggaggcctgagagtgctgaacctgcaaatgcaaggagccagttggcttcggagcccccgggaggcacaggaagtggaggcccagattcctccaagaagctgggctggaaacaggg

SEQ ID NO: 3188 - DNA, 1206 bp, synthetic construct; identical to SEQ ID NO: 282
  misc_feature 1..1206: note = Synthetic polypeptide
  source 1..1206: mol_type = other DNA

SEQ ID NO: 3189 - DNA, 1209 bp, synthetic construct; identical to SEQ ID NO: 281
  misc_feature 1..1209: note = Synthetic polypeptide
  source 1..1209: mol_type = other DNA

SEQ ID NO: 3190 - DNA, 1203 bp, synthetic construct; identical to SEQ ID NO: 286
  misc_feature 1..1203: note = Synthetic polypeptide
  source 1..1203: mol_type = other DNA

SEQ ID NO: 3191 - DNA, 678 bp, synthetic construct
  misc_feature 1..678: note = Synthetic polypeptide
  source 1..678: mol_type = other DNA
atgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgaaccaacagcatcagcattacctgggagctcaccagaaatgcagaatctcaggccccaccccagacctacttgacctaagtctacatttaatgaggtcccggatggttcaagggcatatggacaccggagaggcactg

SEQ ID NO: 3192 - DNA, 165 bp, synthetic construct
  misc_feature 1..165: note = Synthetic polypeptide
  source 1..165: mol_type = other DNA
gctctgcccgaggtgcggcacccactgaaccaacagcatcagcattacctgggagctcaccagaaatgcagaatctcaggccccaccccagacctacttgacctaagtctacatttaatgaggtcccggatggttcaagggcatatggacaccggagaggcactg

SEQ ID NO: 3193 - DNA, 2206 bp, synthetic construct
  misc_feature 1..2206: note = Synthetic polypeptide
  source 1..2206: mol_type = other DNA
atggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacgtatcagagcttttattacaccaataaggactggatttctaggaggtaggcaaagtgtgccttgtttcccaaacttatttgtccacagaattcttttctcacagagtatcacatgggctgagaattcaacagaacacatgttggggaa

SEQ ID NO: 3194 - DNA, 2173 bp, synthetic construct
  misc_feature 1..2173: note = Synthetic polypeptide
  source 1..2173: mol_type = other DNA
atggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacgtatcagagcttttattacaccaataaggactggatttctaggaggtaggcaaagtgtgccttgtttcccaaacttatttgtccacagaattcttttctcacagagtatcacatgggctgagaattcaacagaacacatgttggggaa

SEQ ID NO: 3195 - DNA, 1041 bp, synthetic construct; identical to SEQ ID NO: 969
  misc_feature 1..1041: note = Synthetic polypeptide
  source 1..1041: mol_type = other DNA

SEQ ID NO: 3196 - DNA, 451 bp, synthetic construct; identical to SEQ ID NO: 339
  misc_feature 1..451: note = Synthetic polypeptide
  source 1..451: mol_type = other DNA

SEQ ID NO: 3197 - DNA, 1025 bp, synthetic construct
  misc_feature 1..1025: note = Synthetic polypeptide
  source 1..1025: mol_type = other DNA
atgaggagatttgtctactgcaaggtggttctagccacttcgctgatgtgggttcttgttgatgtcttcttactgctgtacttcagtgaatgtaacaaatgtgatgacaagaaggagagatctctgctgcctgcattgagggctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggacatgccttacaagaagtactaaaaggagttattcaacctaaaggaaaag

SEQ ID NO: 3198 - DNA, 316 bp, synthetic construct
  misc_feature 1..316: note = Synthetic polypeptide
  source 1..316: mol_type = other DNA
ctgcgcagaggggcccggggaaagccggcctcacgggcgggagggagaggcttgagcgaggggctagagccgcgaggactgaccagcaccagaggatacaagaggaggagagagacctcactggttcgggcgacatttcacccccccagcaccccagtcggcacagcttctcacctggggcgggtgggttctgcaccaccctcccaccctccttcctccgtgtggacgatagagccacatccagcaccacggacagctcccgggcggtggagcgtttgtgggagaatccaggaaggggcctcattcctgtctgggt

SEQ ID NO: 3199 - DNA, 263 bp, synthetic construct
  misc_feature 1..263: note = Synthetic polypeptide
  source 1..263: mol_type = other DNA
gggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcggtggagcgtttgtgggagaatccaggaaggggcctcattcctgtctgggt

SEQ ID NO: 3200 - DNA, 221 bp, synthetic construct
  misc_feature 1..221: note = Synthetic polypeptide
  source 1..221: mol_type = other DNA
atgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcggtggagcgtttgtgggagaatccaggaaggggcctcattcctgtctgggt

SEQ ID NO: 3201 - DNA, 260 bp, synthetic construct
  misc_feature 1..260: note = Synthetic polypeptide
  source 1..260: mol_type = other DNA
ccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcggtggagcgtttgtgggagaatccaggaaggggcctcattcctgtctgggt

SEQ ID NO: 3202 - DNA, 565 bp, synthetic construct; identical to SEQ ID NO: 1420
  misc_feature 1..565: note = Synthetic polypeptide
  source 1..565: mol_type = other DNA

SEQ ID NO: 3203 - DNA, 12492 bp, synthetic construct
  misc_feature 1..12492: note = Synthetic polypeptide
  source 1..12492: mol_type = other DNA
atgttggaaggccttgtagcctgggttctcaatacctatttgggaaaatatgtcaataacctgaacactgaccagctctcagttgcacttctcaaaggtgctgttgaattagaaaacttgccattaaagaaagatgccttgaaagaattggaattaccatttgaagtcaaagctggcttcattgggaaagtaacccttcagattcccttttatcgcccccatgtggacccttgggtgatctccatctccagccttcacttaattggagccccagagaaaatacaggatttcaatgatgaaaaggagaagctgttggaaagggaacgtaagaaagcactacttcaagccctggaggagaaatggaagaatgaccgccagcagaaaggggagtcctattggtattcagttaccgcctccgtagttacaaggattgtggagaatattgaattaaaaattcaagatgtccatttacgctttgaagatggtgtcaccaatccctcccatccttttgcttttggcatctgcattaagaatgtgtccatgcaaaatgctgtgaatgagcctgtacagaaactaatgcggaaaaagcaattagacgtagcagaatttagcatctattgggatgtcgattgcactttactgggggatttgcctcagatggagttacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcagctgcaataccggcaaatcatggaattcctcaaggagctggaacgaaaggagaggcaggtgaagttccgaaggtggaaacccaaggtggcgatatctaagaactgccgagaatggtggtattttgctttgaatgctaacttgtatgagatcagagagcagaggaaacgttgcacctgggactttatgttgcaccgcgctcgtgatgctgtatcttacactgacaaatatttcaacaagttaaaaggaggcctgctgtccacagatgacaaggaggaaatgtgtcggattgaagaggaacagagctttgaggaattgaagattttgcgtgaactggttcatgatcgatttcacaaacaggaagaactagcagagagtctgcgggagcctcagtttgattctccaggagcctgtccgggagccccagaacccggtggaggcagtgggatgctgcagtatctccagtcctggtttcctggatggggtggctggtacgggcagcagaccccagaagggaatgtggttgagggactgtcagcagagcaacaggagcagtggattcctgaagagatcctgggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcagatgtaaaacttctagcagagtctcttcctcgaagaaattcctcgttgctttcagtccggttgggtggactgtttcttcgagacctggctacagaaggaactatgtttcctcttctagtcttccctaatccacaaaaagaagttggcagagtctcacaatcttttggtctacaaactacatctgcagacagaagtgatcattacccagctgcagatccagatggccccgtttttgagatgctgtatgagagaaatccggcgcacagccactttgagaggcggctcaatgtcagcacaaggcccttgaacatcatatacaatccgcaggccattaaaaaagtagcagactttttctacaagggaaaggttcatacctcaggttttggttatcagtctgaacttgagctgagagtggctgaagctgcccgaagacaatataacaagctgaagatgcagaccaaggcagaaatccggcaaactcttgatcgtttgctagtgggtgatttcattgaggagagtaaacgatggaccgtgcggctggatatttctgcccctcaggtgatatttcctgatgatttcaaattcaagaatcctgtgttagttgtcgtggatctaggaagaatgcttttgacgaacacccaagataactccaggaggaaaagtagggatgggtcagcatctgaagagacccagtttagtgatgatgaatataagacccccctggccacacctcctaacaccccacctcccgagtcaagcagcagcaacggagagaaaacacctcccttttctggagttgagttcagtgaagaacagcttcaagcacatttaatgagcacaaagatgtatgagaggtactcgctgtcatttatggacctccagatcatggttggacgagtgaaagacaattggaagcatgtccaggatattgacgtgggaccaacacatgtggtagagaagttcaacgttcacctacagttagagcgtcgattgatttatacttcagatcccaaatatccaggagccgtgctctcaggcaacttaccagacttaaaaatccacattaatgaagataaaatatctgcactaaagaattgctttgctctcctcaccaccccagaaatgaaaacttctgacactcagattaaagaaaagatttttccccaggaggagcagcggggaagtttgcaagactccgtaatgaatttaacccagagcattgtgttgttggagcagcatacccgcgaggttctggtggagtcgcagctcctcctggcggaatttaaagtgaactgtatgcagcttggtgttgagagcaatggccggtacatttctgtgctcaaggtgtttggtaccaatgctcactttgtgaagaggccttatgatgctgaagtctccctaactgttcatggtttgctcctggtggataccatgcagacatatggtgctgattttgaccttttgatggcttcacataagaacttgagctttgatattccaacgggaagccttcgggatagcagggcccagtctcctgtctctggaccgaatgtggcccacttaactgatggagctacactgaacgaccgatcagctactagtgtttcacttgacaaaattcttaccaaagagcaagagtcccttattaagttggaatatcagtttgtgagttcagagtgcccatcgatgaatttagacagtactcttcaggtgatttccctacaggtgaataatttagatattatcctcaatccagagacgattgtggagctaattggttttcttcaaaaatcctttcccaaggaaaaagatgatttaagtcctcaacctttaatgactgattttgaaagaagcttcagagaacaaggaacttaccagtctacatatgaacaaaacactgaggttgcagtggaaatccataggctgaacttactgcttcttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagaatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctagtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaacagaggtgaaaacccccaagcgccggcagccatttgtcccctttgctctgaggaaccacacggggtgcactttgtggtttgccaccctgaccaccacacccaccagagctgcactctctcacagtgggagtccaggggtagttccagaagggaacggaacatttctcgatgatactcacaatgttagtgaatggcgagaagtccttacaggtgaagagattccctttgaatttgaagcaagaggaaagttaagacacagacacacccatgacctccggattcatcaactgcaagtgagagtaaatggctgggagcaagtgagcccagtgtctgtggacaaagtcgggaccttttttcgatatgcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtgctgggcactagggcagccgcagctcctagttagccacgtgatcatgaagagggaacaaatactctacagtgggccctgctgccagatgacttcgcccagctgtcagctaatgtaagtgttccgggcatgtttagatatgttaggtgtatgaaattcatttttacttaaagccttttcaacttaaaaatgggcttacccggacgtaatcccatcataagtcaaggagcatctg

SEQ ID NO: 3204 - DNA, 12567 bp, synthetic construct
  misc_feature 1..12567: note = Synthetic polypeptide
  source 1..12567: mol_type = other DNA
atgttggaaggccttgtagcctgggttctcaatacctatttgggaaaatatgtcaataacctgaacactgaccagctctcagttgcacttctcaaaggtgctgttgaattagaaaacttgccattaaagaaagatgccttgaaagaattggaattaccatttgaagtcaaagctggcttcattgggaaagtaacccttcagattcccttttatcgcccccatgtggacccttgggtgatctccatctccagccttcacttaattggagccccagagaaaatacaggatttcaatgatgaaaaggagaagctgttggaaagggaacgtaagaaagcactacttcaagccctggaggagaaatggaagaatgaccgccagcagaaaggggagtcctattggtattcagttaccgcctccgtagttacaaggattgtggagaatattgaattaaaaattcaagatgtccatttacgctttgaagatggtgtcaccaatccctcccatccttttgcttttggcatctgcattaagaatgtgtccatgcaaaatgctgtgaatgagcctgtacagaaactaatgcggaaaaagcaattagacgtagcagaatttagcatctattgggatgtcgattgcactttactgggggatttgcctcagatggagttacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcagctgcaataccggcaaatcatggaattcctcaaggagctggaacgaaaggagaggcaggtgaagttccgaaggtggaaacccaaggtggcgatatctaagaactgccgagaatggtggtattttgctttgaatgctaacttgtatgagatcagagagcagaggaaacgttgcacctgggactttatgttgcaccgcgctcgtgatgctgtatcttacactgacaaatatttcaacaagttaaaaggaggcctgctgtccacagatgacaaggaggaaatgtgtcggattgaagaggaacagagctttgaggaattgaagattttgcgtgaactggttcatgatcgatttcacaaacaggaagaactagcagagagtctgcgggagcctcagtttgattctccaggagcctgtccgggagccccagaacccggtggaggcagtgggatgctgcagtatctccagtcctggtttcctggatggggtggctggtacgggcagcagaccccagaagggaatgtggttgagggactgtcagcagagcaacaggagcagtggattcctgaagagatcctgggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcagatgtaaaacttctagcagagtctcttcctcgaagaaattcctcgttgctttcagtccggttgggtggactgtttcttcgagacctggctacagaaggaactatgtttcctcttctagtcttccctaatccacaaaaagaagttggcagagtctcacaatcttttggtctacaaactacatctgcagacagaagtgatcattacccagctgcagatccagatggccccgtttttgagatgctgtatgagagaaatccggcgcacagccactttgagaggcggctcaatgtcagcacaaggcccttgaacatcatatacaatccgcaggccattaaaaaagtagcagactttttctacaagggaaaggttcatacctcaggttttggttatcagtctgaacttgagctgagagtggctgaagctgcccgaagacaatataacaagctgaagatgcagaccaaggcagaaatccggcaaactcttgatcgtttgctagtgggtgatttcattgaggagagtaaacgatggaccgtgcggctggatatttctgcccctcaggtgatatttcctgatgatttcaaattcaagaatcctgtgttagttgtcgtggatctaggaagaatgcttttgacgaacacccaagataactccaggaggaaaagtagggatgggtcagcatctgaagagacccagtttagtgatgatgaatataagacccccctggccacacctcctaacaccccacctcccgagtcaagcagcagcaacggagagaaaacacctcccttttctggagttgagttcagtgaagaacagcttcaagcacatttaatgagcacaaagatgtatgagaggtactcgctgtcatttatggacctccagatcatggttggacgagtgaaagacaattggaagcatgtccaggatattgacgtgggaccaacacatgtggtagagaagttcaacgttcacctacagttagagcgtcgattgatttatacttcagatcccaaatatccaggagccgtgctctcaggcaacttaccagacttaaaaatccacattaatgaagataaaatatctgcactaaagaattgctttgctctcctcaccaccccagaaatgaaaacttctgacactcagattaaagaaaagatttttccccaggaggagcagcggggaagtttgcaagactccgtaatgaatttaacccagagcattgtgttgttggagcagcatacccgcgaggttctggtggagtcgcagctcctcctggcggaatttaaagtgaactgtatgcagcttggtgttgagagcaatggccggtacatttctgtgctcaaggtgtttggtaccaatgctcactttgtgaagaggccttatgatgctgaagtctccctaactgttcatggtttgctcctggtggataccatgcagacatatggtgctgattttgaccttttgatggcttcacataagaacttgagctttgatattccaacgggaagccttcgggatagcagggcccagtctcctgtctctggaccgaatgtggcccacttaactgatggagctacactgaacgaccgatcagctactagtgtttcacttgacaaaattcttaccaaagagcaagagtcccttattaagttggaatatcagtttgtgagttcagagtgcccatcgatgaatttagacagtactcttcaggtgatttccctacaggtgaataatttagatattatcctcaatccagagacgattgtggagctaattggttttcttcaaaaatcctttcccaaggaaaaagatgatttaagtcctcaacctttaatgactgattttgaaagaagcttcagagaacaaggaacttaccagtctacatatgaacaaaacactgaggttgcagtggaaatccataggctgaacttactgcttcttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagaatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctagtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaagcctcccccttgtctaccttagaactaggagtacagccagtctgactaacctagagcaccagatctatgctagagcagaggtgaaaacccccaagcgccggcagccatttgtcccctttgctctgaggaaccacacggggtgcactttgtggtttgccaccctgaccaccacacccaccagagctgcactctctcacagtgggagtccaggggtagttccagaagggaacggaacatttctcgatgatactcacaatgttagtgaatggcgagaagtccttacaggtgaagagattccctttgaatttgaagcaagaggaaagttaagacacagacacacccatgacctccggattcatcaactgcaagtgagagtaaatggctgggagcaagtgagcccagtgtctgtggacaaagtcgggaccttttttcgatatgcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtgctgggcactagggcagccgcagctcctagttagccacgtgatcatgaagagggaacaaatactctacagtgggccctgctgccagatgacttcgcccagctgtcagctaatgtaagtgttccgggcatgtttagatatgttaggtgtatgaaattcatttttacttaaagccttttcaacttaaaaatgggcttacccggacgtaatcccatcataagtcaaggagcatctg

SEQ ID NO: 3205 - DNA, 9032 bp, synthetic construct
  misc_feature 1..9032: note = Synthetic polypeptide
  source 1..9032: mol_type = other DNA
ttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagaatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctagtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaagcctcccccttgtctaccttagaactaggagtacagccagtctgactaacctagagcaccagatctatgctagagaggtgaaaacccccaagcgccggcagccatttgtcccctttgctctgaggaaccacacggggtgcactttgtggtttgccaccctgaccaccacacccaccagagctgcactctctcacagtgggagtccaggggtagttccagaagggaacggaacatttctcgatgatactcacaatgttagtgaatggcgagaagtccttacaggtgaagagattccctttgaatttgaagcaagaggaaagttaagacacagacacacccatgacctccggattcatcaactgcaagtgagagtaaatggctgggagcaagtgagcccagtgtctgtggacaaagtcgggaccttttttcgatatgcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtgctgggcactagggcagccgcagctcctagttagccacgtgatcatgaagagggaacaaatactctacagtgggccctgctgccagatgacttcgcccagctgtcagctaatgtaagtgttccgggcatgtttagatatgttaggtgtatgaaattcatttttacttaaagccttttcaacttaaaaatgggcttacccggacgtaatcccatcataagtcaaggagcatctg

SEQ ID NO: 3206 - DNA, 561 bp, synthetic construct
  misc_feature 1..561: note = Synthetic polypeptide
  source 1..561: mol_type = other DNA
atgagaggagagaaactcagtaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtgctgggcactagggcagccgcagctcctagttagccacgtgatcatgaagagggaacaaatactctacagtgggccctgctgccagatgacttcgcccagctgtcagctaatgtaagtgttccgggcatgtttagatatgttaggtgtatgaaattcatttttacttaaagccttttcaacttaaaaatgggcttacccggacgtaatcccatcataagtcaaggagcatctg

SEQ ID NO: 3207 - DNA, 621 bp, synthetic construct
  misc_feature 1..621: note = Synthetic polypeptide
  source 1..621: mol_type = other DNA
atgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgcacaatcctggttcaggtttctttcattcttccacacaaggactcctaggatagcctctacctgttccccagcttctggcctctgctgtcagaatgaataatccaacacatgggcctgaccctgctcaaaatccttcagtggctcccatggctccctactgcttcaggttaaagctccagctcctgactgagaaggttctgtgtgttctggcccctgcctatctctccatcctcctctcccgcttgccctttattcttctgtcacctgaacagcttgtcttttcccagccaaaatgtttcccagcttcatgcctttgctgatgtgtaccttctgattaggatgcctctcccctccagctgactaatgcctcatcttttaacacttagcttggtgtctccctctccacctttggctgggctagatggccctctttggtgcctctatagtac

SEQ ID NO: 3208 - DNA, 1426 bp, synthetic construct; identical to SEQ ID NO: 1626
  misc_feature 1..1426: note = Synthetic polypeptide
  source 1..1426: mol_type = other DNA

SEQ ID NO: 3209 - DNA, 721 bp, synthetic construct
  misc_feature 1..721: note = Synthetic polypeptide
  source 1..721: mol_type = other DNA
atgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggaggacgaagtgggaggatcactcaaggccagcagtttaggactaacctggacatcatagcaagaccctgtctctacaaacaatataaaaactagctgagcatggtggtgtgcacctgtagtcctggctactctggaggctgaggtagggagcatctcttagcccaggaattcaaggctgcagtgagctatgattgggccactgcatttcagcctgggtgacacagggagaccc

SEQ ID NO: 3210 - DNA, 1728 bp, synthetic construct; identical to SEQ ID NO: 2224
  misc_feature 1..1728: note = Synthetic polypeptide
  source 1..1728: mol_type = other DNA

SEQ ID NO: 3211 - DNA, 1680 bp, synthetic construct; identical to SEQ ID NO: 2225
  misc_feature 1..1680: note = Synthetic polypeptide
  source 1..1680: mol_type = other DNA

SEQ ID NO: 3212 - DNA, 1512 bp, synthetic construct; identical to SEQ ID NO: 2226
  misc_feature 1..1512: note = Synthetic polypeptide
  source 1..1512: mol_type = other DNA

SEQ ID NO: 3213 - DNA, 5394 bp, synthetic construct
  misc_feature 1..5394: note = Synthetic polypeptide
  source 1..5394: mol_type = other DNA
atggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggatgacaagaaaacaagctcaaattagatatttggtcaaaagaagcaatttctaattgcctagggtcattacagcttcagcctcatctctcatatcttctacttc

SEQ ID NO: 3214 - DNA, 5259 bp, synthetic construct
  misc_feature 1..5259: note = Synthetic polypeptide
  source 1..5259: mol_type = other DNA
atgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggatgacaagaaaacaagctcaaattagatatttggtcaaaagaagcaatttctaattgcctagggtcattacagcttcagcctcatctctcatatcttctacttc

SEQ ID NO: 3215 - DNA, 5409 bp, synthetic construct
  misc_feature 1..5409: note = Synthetic polypeptide
  source 1..5409: mol_type = other DNA
atgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggatgacaagaaaacaagctcaaattagatatttggtcaaaagaagcaatttctaattgcctagggtcattacagcttcagcctcatctctcatatcttctacttc

SEQ ID NO: 3216 - DNA, 5403 bp, synthetic construct
  misc_feature 1..5403: note = Synthetic polypeptide
  source 1..5403: mol_type = other DNA
atgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctgtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggatgacaagaaaacaagctcaaattagatatttggtcaaaagaagcaatttctaattgcctagggtcattacagcttcagcctcatctctcatatcttctacttc

SEQ ID NO: 3217 - DNA, 272 bp, synthetic construct
  misc_feature 1..272: note = Synthetic polypeptide
  source 1..272: mol_type = other DNA
acaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggatgacaagaaaacaagctcaaattagatatttggtcaaaagaagcaatttctaattgcctagggtcattacagcttcagcctcatctctcatatcttctacttc

SEQ ID NO: 3218 - DNA, 303 bp, synthetic construct; identical to SEQ ID NO: 148
  misc_feature 1..303: note = Synthetic polypeptide
  source 1..303: mol_type = other DNA

SEQ ID NO: 3219 - DNA, 301 bp, synthetic construct; identical to SEQ ID NO: 147
  misc_feature 1..301: note = Synthetic polypeptide
  source 1..301: mol_type = other DNA

SEQ ID NO: 3220 - DNA, 3174 bp, synthetic construct
  misc_feature 1..3174: note = Synthetic polypeptide
  source 1..3174: mol_type = other DNA
atggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctctcaaaggcatgaacatgaaagagataaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggaattcagggaccccgaatggagggactggctggagccttggcagaggacataaattgtgaagatttcatggacatttatcagtttccaaataatactttcataatttcttactcctgtctttattttaatctcttaatcctgttatcttcgtaaattgaggatgtacatcacctcaggatcactgtgatgattgtgtttactgtacaaattgattgtaaaacatgtgtgtttgaacaatatgaaatcagtgcaccttgaaaaagaacagaataacagtgattttagggaacaagggaagacaaccataaggtctgactgcctgtagggtcaggcaaaaagagccatatttttcttcttgcagagagcctataaatgggtgtgcaagtaggagagatatcgctaaattcttttcctagcaagaaatattaatattaagaccttaggaaaataattgcatcccttgggggaggtctataaatggccactctgggagtgtctgtcttaagtggttgagataaagcctgaaataaggctctgggagtgtctgtcttaagtggttgagataaggccctggtctcctgcagtaccatcaggcttactaggattgggaaaccccaaccctggtaaatttgagttcagactggttctctgctcttgaaccctgttttctgttaagatgtttatcaagactatatgtgcactgctgaacgtagacccttatcgggagttctgattttgtccttgctgtgtttcctcagaagcatgtgatctttgctctgctttttaccccttaaagcatgtgacctactccctgtttgtacaccccctccccttttgaaatccctgataaaaacttgctggttttgcagctcaggttggcatcacggtcctaccgctatgtgatgtcacccccagcagcccagctgtaaaattcctctctttgtactctttatttctcagaccagccaacacttagggaaaatagaaagaacctacgttgaaatattgggggcgggttcccccaata

SEQ ID NO: 3221 - DNA, 2751 bp, synthetic construct
  misc_feature 1..2751: note = Synthetic polypeptide
  source 1..2751: mol_type = other DNA
atggccggcctgaccttatttgtgggccgcctcccgccctcggcccgcagtgagcagctggaggaactgttcagtcaggtggggccggtgaagcagtgcttcgtggtgactgaaaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggaattcagggaccccgaatggagggactggctggagccttggcagaggacataaattgtgaagatttcatggacatttatcagtttccaaataatactttcataatttcttactcctgtctttattttaatctcttaatcctgttatcttcgtaaattgaggatgtacatcacctcaggatcactgtgatgattgtgtttactgtacaaattgattgtaaaacatgtgtgtttgaacaatatgaaatcagtgcaccttgaaaaagaacagaataacagtgattttagggaacaagggaagacaaccataaggtctgactgcctgtagggtcaggcaaaaagagccatatttttcttcttgcagagagcctataaatgggtgtgcaagtaggagagatatcgctaaattcttttcctagcaagaaatattaatattaagaccttaggaaaataattgcatcccttgggggaggtctataaatggccactctgggagtgtctgtcttaagtggttgagataaagcctgaaataaggctctgggagtgtctgtcttaagtggttgagataaggccctggtctcctgcagtaccatcaggcttactaggattgggaaaccccaaccctggtaaatttgagttcagactggttctctgctcttgaaccctgttttctgttaagatgtttatcaagactatatgtgcactgctgaacgtagacccttatcgggagttctgattttgtccttgctgtgtttcctcagaagcatgtgatctttgctctgctttttaccccttaaagcatgtgacctactccctgtttgtacaccccctccccttttgaaatccctgataaaaacttgctggttttgcagctcaggttggcatcacggtcctaccgctatgtgatgtcacccccagcagcccagctgtaaaattcctctctttgtactctttatttctcagaccagccaacacttagggaaaatagaaagaacctacgttgaaatattgggggcgggttcccccaata

SEQ ID NO: 3222 - DNA, 615 bp, synthetic construct; identical to SEQ ID NO: 1055
  misc_feature 1..615: note = Synthetic polypeptide
  source 1..615: mol_type = other DNA

SEQ ID NO: 3223 - DNA, 861 bp, synthetic construct; identical to SEQ ID NO: 1056
  misc_feature 1..861: note = Synthetic polypeptide
  source 1..861: mol_type = other DNA

SEQ ID NO: 3224 - DNA, 62 bp, synthetic construct; identical to SEQ ID NO: 1057
  misc_feature 1..62: note = Synthetic polypeptide
  source 1..62: mol_type = other DNA

SEQ ID NO: 3225 - DNA, 123 bp, synthetic construct; identical to SEQ ID NO: 1058
  misc_feature 1..123: note = Synthetic polypeptide
  source 1..123: mol_type = other DNA

SEQ ID NO: 3226 - DNA, 501 bp, synthetic construct; identical to SEQ ID NO: 2341
  misc_feature 1..501: note = Synthetic polypeptide
  source 1..501: mol_type = other DNA

SEQ ID NO: 3227 - DNA, 280 bp, synthetic construct
  misc_feature 1..280: note = Synthetic polypeptide
  source 1..280: mol_type = other DNA
atgcagaagcccagcggcctgaagccccccggccgtggggggaagcactccagccccatgggccggacatctactgggtcagcttcatcctcggcggcggtggccgctagctccaaggaaggcacggtggtgtatacctgtggttccagttacttggcagcctgaagtaggagatccgcttgagcccaggaggtcgaggctgcggtgagttttgatcacaccactgcactccaacctgggtgacccagcgagaccctgactcaaaaacaaaacaaaaaaa

SEQ ID NO: 3228 - DNA, 500 bp, synthetic construct; identical to SEQ ID NO: 204
  misc_feature 1..500: note = Synthetic polypeptide
  source 1..500: mol_type = other DNA

SEQ ID NO: 3229 - DNA, 656 bp, synthetic construct; identical to SEQ ID NO: 205
  misc_feature 1..656: note = Synthetic polypeptide
  source 1..656: mol_type = other DNA

SEQ ID NO: 3230 - DNA, 524 bp, synthetic construct; identical to SEQ ID NO: 207
  misc_feature 1..524: note = Synthetic polypeptide
  source 1..524: mol_type = other DNA

SEQ ID NO: 3231 - DNA, 559 bp, synthetic construct
  misc_feature 1..559: note = Synthetic polypeptide
  source 1..559: mol_type = other DNA
atggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctc

SEQ ID NO: 3232 - DNA, 508 bp, synthetic construct
  misc_feature 1..508: note = Synthetic polypeptide
  source 1..508: mol_type = other DNA
atgtggggcgacctcacagagacgggatgtatgggacggcggagtgcaaagaaagatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctc

SEQ ID NO: 3233 - DNA, 453 bp, synthetic construct
  misc_feature 1..453: note = Synthetic polypeptide
  source 1..453: mol_type = other DNA
atcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctc

SEQ ID NO: 3234 - DNA, 415 bp, synthetic construct
  misc_feature 1..415: note = Synthetic polypeptide
  source 1..415: mol_type = other DNA
atgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctc

SEQ ID NO: 3235 - DNA, 329 bp, synthetic construct
  misc_feature 1..329: note = Synthetic polypeptide
  source 1..329: mol_type = other DNA
gatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctc

SEQ ID NO: 3236 - DNA, 359 bp, synthetic construct; identical to SEQ ID NO: 2309
  misc_feature 1..359: note = Synthetic polypeptide
  source 1..359: mol_type = other DNA

SEQ ID NO: 3237 - DNA, 321 bp, synthetic construct; identical to SEQ ID NO: 2310
  misc_feature 1..321: note = Synthetic polypeptide
  source 1..321: mol_type = other DNA

SEQ ID NO: 3238 - DNA, 679 bp, synthetic construct
  misc_feature 1..679: note = Synthetic polypeptide
  source 1..679: mol_type = other DNA
atgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctgagtccaagtgaattttatggtgaagaaacatttgtttgaagttcagcaaaatttgtaagtgtccattttcttcttttgaagtcaagttaaaattaaatgtaatacttttaattaaaaaagatgtgtataactttaattctcaccctttctcctttcccttcatcccgtcctatccttctacccagtgacctatttttaggtctacttggaaggatatctagaatgatgttcactgatggttattttgggtaatgagatgggttattattttttactcttaaacttttcggtgttacttaaattctttataatga

SEQ ID NO: 3239 - DNA, 1808 bp, synthetic construct
  misc_feature 1..1808: note = Synthetic polypeptide
  source 1..1808: mol_type = other DNA
atggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggccaggcacagtggctcacaactgtaatcccggcactttgggaggttgagacaggagaattgcttgaggccagaagttcaagaccagcctcggcaacatagtaagacccccatctctacaaaaaggttaaaaactagccaggtgtggtggcacacacctatagtcccagttactctgaaagctgaagcaagaggatgagttgaaccctaggaggtagaggctgcagtgagctgtgatcatgccactgcactccagcctgggcaacagagcaagaccctatctaaaaaaaaaaaaaaaaaaaaaaaaaaaaa

SEQ ID NO: 3240 - DNA, 788 bp, synthetic construct
  misc_feature 1..788: note = Synthetic polypeptide
  source 1..788: mol_type = other DNA
atggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggccaggcacagtggctcacaactgtaatcccggcactttgggaggttgagacaggagaattgcttgaggccagaagttcaagaccagcctcggcaacatagtaagacccccatctctacaaaaaggttaaaaactagccaggtgtggtggcacacacctatagtcccagttactctgaaagctgaagcaagaggatgagttgaaccctaggaggtagaggctgcagtgagctgtgatcatgccactgcactccagcctgggcaacagagcaagaccctatctaaaaaaaaaaaaaaaaaaaaaaaaaaaaa

SEQ ID NO: 3241 - DNA, 1589 bp, synthetic construct
  misc_feature 1..1589: note = Synthetic polypeptide
  source 1..1589: mol_type = other DNA
atggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggccaggcacagtggctcacaactgtaatcccggcactttgggaggttgagacaggagaattgcttgaggccagaagttcaagaccagcctcggcaacatagtaagacccccatctctacaaaaaggttaaaaactagccaggtgtggtggcacacacctatagtcccagttactctgaaagctgaagcaagaggatgagttgaaccctaggaggtagaggctgcagtgagctgtgatcatgccactgcactccagcctgggcaacagagcaagaccctatctaaaaaaaaaaaaaaaaaaaaaaaaaaaaa

SEQ ID NO: 3242 - DNA, 986 bp, synthetic construct
  misc_feature 1..986: note = Synthetic polypeptide
  source 1..986: mol_type = other DNA
atggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggccaggcacagtggctcacaactgtaatcccggcactttgggaggttgagacaggagaattgcttgaggccagaagttcaagaccagcctcggcaacatagtaagacccccatctctacaaaaaggttaaaaactagccaggtgtggtggcacacacctatagtcccagttactctgaaagctgaagcaagaggatgagttgaaccctaggaggtagaggctgcagtgagctgtgatcatgccactgcactccagcctgggcaacagagcaagaccctatctaaaaaaaaaaaaaaaaaaaaaaaaaaaaa

SEQ ID NO: 3243 - DNA, 651 bp, synthetic construct; identical to SEQ ID NO: 2328
  misc_feature 1..651: note = Synthetic polypeptide
  source 1..651: mol_type = other DNA

SEQ ID NO: 3244 - DNA, 1382 bp, synthetic construct
  misc_feature 1..1382: note = Synthetic polypeptide
  source 1..1382: mol_type = other DNA
atgaagactctcagggcgcgatttaagaagacagagctgcggctcagccccactgaccttggctcctgcccgccctgcggcccctgccccatcccgaagccggcagccagaggcaggcgccagagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacggaggcagcaggagccacctgggcctcctcgctgttcctccaactcgccaggcgcagtcctgcctcagggcctttgcaccaccagtgtcctctgcctggaatgctctagcgcagtcctgcctcagggcctttgcaccacctgtgtcctctgcctggaatgctctagccccagatggccccacagctctttacctcacctactttatgcagtaggctcctcgccaaagacacttcccatgcccacttcccatgcccacttcccatgcccactttcttcaaaattgtaacatcaccccccaccacccccccggccaactcgctagttcactttattttt

SEQ ID NO: 3245 - DNA, 1295 bp, synthetic construct
  misc_feature 1..1295: note = Synthetic polypeptide
  source 1..1295: mol_type = other DNA
atgaagactctcagggcgcgatttaagaagacagagagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacggaggcagcaggagccacctgggcctcctcgctgttcctccaactcgccaggcgcagtcctgcctcagggcctttgcaccaccagtgtcctctgcctggaatgctctagcgcagtcctgcctcagggcctttgcaccacctgtgtcctctgcctggaatgctctagccccagatggccccacagctctttacctcacctactttatgcagtaggctcctcgccaaagacacttcccatgcccacttcccatgcccacttcccatgcccactttcttcaaaattgtaacatcaccccccaccacccccccggccaactcgctagttcactttattttt

SEQ ID NO: 3246 - DNA, 1652 bp, synthetic construct
  misc_feature 1..1652: note = Synthetic polypeptide
  source 1..1652: mol_type = other DNA
atgcagccggcggcctgcgctggtgagggagccgggcccccggcgccgcgtcctcctcatcctccaggcgacaaggtcaggaggggccggggcggcgccccttccctcagcccccagcccccagccccctacctgggtcttcccattccatcccgtgggggagggggctggcgaggagggcaagggggagggggcggcaccagggagggcgggaccgggcgggcgggcggggcggggagctccggcagcgcccagccccgccctccggccgctccccgcggtccctccagaccctctggccgccgcctcctcttggaaccccgtgcgccccccgcgccccgcgccccggacgccatgaagcagctgtgtctgtgcgcagccgcctccttcgcgagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacggaggcagcaggagccacctgggcctcctcgctgttcctccaactcgccaggcgcagtcctgcctcagggcctttgcaccaccagtgtcctctgcctggaatgctctagcgcagtcctgcctcagggcctttgcaccacctgtgtcctctgcctggaatgctctagccccagatggccccacagctctttacctcacctactttatgcagtaggctcctcgccaaagacacttcccatgcccacttcccatgcccacttcccatgcccactttcttcaaaattgtaacatcaccccccaccacccccccggccaactcgctagttcactttattttt

SEQ ID NO: 3247 - DNA, 285 bp, synthetic construct; identical to SEQ ID NO: 1623
  misc_feature 1..285: note = Synthetic polypeptide
  source 1..285: mol_type = other DNA

SEQ ID NO: 3248 - DNA, 1094 bp, synthetic construct; identical to SEQ ID NO: 153
  misc_feature 1..1094: note = Synthetic polypeptide
  source 1..1094: mol_type = other DNA

SEQ ID NO: 3249 - DNA, 1668 bp, synthetic construct
  misc_feature 1..1668: note = Synthetic polypeptide
  source 1..1668: mol_type = other DNA
atgctcctatgttaccgccacctaaaaacaaagaggattttgagaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagtgggacagtgggggaagagctctgactctagagcttggtctcaaattctgacctgactctcctgtgtgaccatgcacatggtacttaatctttctgagtctcaattttcatctctagaatgaggataatagtaattttcttagggatgctttaaatgattacatgaaatggtctgtggaaagctgtttagtatattgtttggcctgtggtaagcactcagtaaatgtatagctgctgtt

SEQ ID NO: 3250 - DNA, 2895 bp, synthetic construct
  misc_feature 1..2895: note = Synthetic polypeptide
  source 1..2895: mol_type = other DNA
atggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagtgggacagtgggggaagagctctgactctagagcttggtctcaaattctgacctgactctcctgtgtgaccatgcacatggtacttaatctttctgagtctcaattttcatctctagaatgaggataatagtaattttcttagggatgctttaaatgattacatgaaatggtctgtggaaagctgtttagtatattgtttggcctgtggtaagcactcagtaaatgtatagctgctgtt

SEQ ID NO: 3251 - DNA, 2892 bp, synthetic construct
  misc_feature 1..2892: note = Synthetic polypeptide
  source 1..2892: mol_type = other DNA
atggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcaggcaaattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagtgggacagtgggggaagagctctgactctagagcttggtctcaaattctgacctgactctcctgtgtgaccatgcacatggtacttaatctttctgagtctcaattttcatctctagaatgaggataatagtaattttcttagggatgctttaaatgattacatgaaatggtctgtggaaagctgtttagtatattgtttggcctgtggtaagcactcagtaaatgtatagctgctgtt

SEQ ID NO: 3252 - DNA, 1596 bp, synthetic construct
  misc_feature 1..1596: note = Synthetic polypeptide
  source 1..1596: mol_type = other DNA
atgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagtgggacagtgggggaagagctctgactctagagcttggtctcaaattctgacctgactctcctgtgtgaccatgcacatggtacttaatctttctgagtctcaattttcatctctagaatgaggataatagtaattttcttagggatgctttaaatgattacatgaaatggtctgtggaaagctgtttagtatattgtttggcctgtggtaagcactcagtaaatgtatagctgctgtt

SEQ ID NO: 3253 - DNA, 853 bp, synthetic construct
  misc_feature 1..853: note = Synthetic polypeptide
  source 1..853: mol_type = other DNA
tattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagtgggacagtgggggaagagctctgactctagagcttggtctcaaattctgacctgactctcctgtgtgaccatgcacatggtacttaatctttctgagtctcaattttcatctctagaatgaggataatagtaattttcttagggatgctttaaatgattacatgaaatggtctgtggaaagctgtttagtatattgtttggcctgtggtaagcactcagtaaatgtatagctgctgtt

SEQ ID NO: 3254 - DNA, 200 bp, synthetic construct
  misc_feature 1..200: note = Synthetic polypeptide
  source 1..200: mol_type = other DNA
atgagtgccaacaccttcggcaatgccggcttttccgttctcctgcctggggcccggctcgagggccgctgtgggcccaccaatgcccgggtcagatgccatctggataaccagatgcaacgtgaagatctagactggaccctggtttgatgaaccagctgtaaaaacacatttctggaacaactggagaaaccggagta

SEQ ID NO: 3255 - DNA, 1043 bp, synthetic construct
  misc_feature 1..1043: note = Synthetic polypeptide
  source 1..1043: mol_type = other DNA
atgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctggataaccagatgcaacgtgaagatctagactggaccctggtttgatgaaccagctgtaaaaacacatttctggaacaactggagaaaccggagta

SEQ ID NO: 3256 - DNA, 821 bp, synthetic construct
  misc_feature 1..821: note = Synthetic polypeptide
  source 1..821: mol_type = other DNA
atgcgaatcctaaagcgtttcctcgcttgcattcagctcctctgtgtttgccgcctggaagctgctggagtatatgctccagtgctcaccaaaataagggaataaaccaataaaggggattcatgggattcaggaaaccagagttgcagccagtgaaacagcaatcaaaatgacctgagcacacaagctaggcagagcctgctgccctcagtccaactggaacgagttccagtccaactggaatgagaggatttcggggaggaaagtggaaattctatattacttattcattgactgcatcagacaatatattaatccatatgtgttttgaaaatctagaagtgttttacagatttggagaaaattagcaattggtcctgagaaaataatcaaatttaaaagaccttaattaactgcaagaaaaagtcgagtagaaagtataatcataatacactactttgctcaacagtcatgaatatttacataatgataacgttgaatacctctaaaatatgatatttatactctaggtttggagagaatagaactatttaagttagcataaatacttatacatgaaagtaaaaaggtaatatatagtatctaaaatttagaagtcaaaaattacaataagagtatgttatctgaaaatatggagttaaattacagaagagatagctgaaagaattgaaaatgtgacctgtgggacactggactggagaggtggagtgaaatgaagcagggtacagctgctttccattatgagtctggcagtagtccttgaagttttaaactacatgcatgtctaacaaaaaagtaaa

SEQ ID NO: 3257 - DNA, 162 bp, synthetic construct; identical to SEQ ID NO: 2231
  misc_feature 1..162: note = Synthetic polypeptide
  source 1..162: mol_type = other DNA

SEQ ID NO: 3258 - DNA, 245 bp, synthetic construct
  misc_feature 1..245: note = Synthetic polypeptide
  source 1..245: mol_type = other DNA
atgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggctgaagtaggaggatcacttgaggccgagtccaaggttacagtgaactatgattgcaccatacactccagcctgggtgacagagtgagagcctgtct

SEQ ID NO: 3259 - DNA, 125 bp, synthetic construct
  misc_feature 1..125: note = Synthetic polypeptide
  source 1..125: mol_type = other DNA
ccagccgcaggggccacccgaacagtctctcctcctcacagaagcctggagctgggcatccaagaagaagcagcctcatttgttttctggtgtcatcgtaggtggccacctatggcttttgggaa

SEQ ID NO: 3260 - DNA, 115 bp, synthetic construct
  misc_feature 1..115: note = Synthetic polypeptide
  source 1..115: mol_type = other DNA
gggccacccgaacagtctctcctcctcacagaagcctggagctgggcatccaagaagaagcagcctcatttgttttctggtgtcatcgtaggtggccacctatggcttttgggaa

SEQ ID NO: 3261 - DNA, 112 bp, synthetic construct
  misc_feature 1..112: note = Synthetic polypeptide
  source 1..112: mol_type = other DNA
ccacccgaacagtctctcctcctcacagaagcctggagctgggcatccaagaagaagcagcctcatttgttttctggtgtcatcgtaggtggccacctatggcttttgggaa

SEQ ID NO: 3262 - DNA, 2114 bp, synthetic construct
  misc_feature 1..2114: note = Synthetic polypeptide
  source 1..2114: mol_type = other DNA
atggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagcttcctctccagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgaggtggcctggtttgctttcgaccctggctcggcgcactcggacatcatcctctccaatgacaacctgacagtgacctgtagtagctatgatgaccgggtggtgctagggaagactggcttctccaagggcatccactactgggagctcacggtagatcgctatgacaaccaccctgatcctgcctttggtgtggctcgcatggacgtgatgaaggatgtgatgttaggaaaagacgacaaagcttgggcaatgtatgtggacaataaccggagctggttcatgcacaacaactcgcacaccaacagaactgagggagggatcacaaaaggggccacaattggggtcctcctcgacttaaatagaaaaaacttgacattttttatcaacgatgaacaacaaggtcccatagcatttgataacgtggagggcctcttcttccctgcggtcagcctgaacaggaacgtgcaggggtgtcctgaaaccaaggcttcacggatatggagagacaaccg

SEQ ID NO: 3263 - DNA, 2357 bp, synthetic construct
  misc_feature 1..2357: note = Synthetic polypeptide
  source 1..2357: mol_type = other DNA
atggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgaggacacagattcagaagaacagaccctcccttttccagtgccttcggaaagattgccgctccgtagaatgagtcctttctcctccacccttaatctacaacccagcttccccgggagatcctactttgatttccgatcctcaccccaccagctgagcttgcattcctctttacagtctctcaatgcaccgggatgcaattttgagacacaatctgcaccttactctcaattagttgacattaaaaagctgttggcagtggcctggtttgctttcgaccctggctcggcgcactcggacatcatcctctccaatgacaacctgacagtgacctgtagtagctatgatgaccgggtggtgctagggaagactggcttctccaagggcatccactactgggagctcacggtagatcgctatgacaaccaccctgatcctgcctttggtgtggctcgcatggacgtgatgaaggatgtgatgttaggaaaagacgacaaagcttgggcaatgtatgtggacaataaccggagctggttcatgcacaacaactcgcacaccaacagaactgagggagggatcacaaaaggggccacaattggggtcctcctcgacttaaatagaaaaaacttgacattttttatcaacgatgaacaacaaggtcccatagcatttgataacgtggagggcctcttcttccctgcggtcagcctgaacaggaacgtgcaggggtgtcctgaaaccaaggcttcacggatatggagagacaaccg

SEQ ID NO: 3264 - DNA, 821 bp, synthetic construct; identical to SEQ ID NO: 2348
  misc_feature 1..821: note = Synthetic polypeptide
  source 1..821: mol_type = other DNA

SEQ ID NO: 3265 - DNA, 656 bp, synthetic construct; identical to SEQ ID NO: 2349
  misc_feature 1..656: note = Synthetic polypeptide
  source 1..656: mol_type = other DNA

SEQ ID NO: 3266 - DNA, 780 bp, synthetic construct; identical to SEQ ID NO: 2350
  misc_feature 1..780: note = Synthetic polypeptide
  source 1..780: mol_type = other DNA

SEQ ID NO: 3267 - DNA, 439 bp, synthetic construct; identical to SEQ ID NO: 2351
  misc_feature 1..439: note = Synthetic polypeptide
  source 1..439: mol_type = other DNA

SEQ ID NO: 3268 - DNA, 2961 bp, synthetic construct
  misc_feature 1..2961: note = Synthetic polypeptide
  source 1..2961: mol_type = other DNA
atgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagtaagtggggataaaatgccctgattcaccctcagagggatg

SEQ ID NO: 3269 - DNA, 2964 bp, synthetic construct
  misc_feature 1..2964: note = Synthetic polypeptide
  source 1..2964: mol_type = other DNA
atgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagtaagtggggataaaatgccctgattcaccctcagagggatg

SEQ ID NO: 3270 - DNA, 2827 bp, synthetic construct
  misc_feature 1..2827: note = Synthetic polypeptide
  source 1..2827: mol_type = other DNA
atggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatccggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagccttcctgcataccctggaccagcagaaacctagagtgagcaaatcatggaggaagataaaaaacatggtgcactggtctcccttcgtcatgtccttcaagaagaagtacccctggatccagctggcaggacacgcagggagtttcaaggcagctgccaatggcaggatcctgaagaagcactgtgagtcagagcagcgctgcctggaccggctgatggtggatgtgctgaggcccttcgtacctgcctaccatggggatgtggtgaaggacggggagcgctacaaccagatggacgacctgctggccgacttcgactcgccctgtgtgatggactgcaagatgggaatcaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaagaaagaagacggcaccgtgaaccgggacttcaagaagaccaaaacgagggagcaggtcaccgaggccttcagagagttcactaaaggaaaccataacatcctgatcgcctatcgggaccggctgaaggccattcgaaccactctagaagtttctcccttcttcaagtgccacgaggccatcaaactctgaacagtcatgcaaccggagcttctgatgatggcctcttctgctggggacccttagacaggcatctgagggacctctgactgccatttcccaaaaacagtgccccctgtcagcaggaagcagttaagatcagtcttcatccttatccttaatctaagggcagttagatggacttctttcgaggcgggaa

SEQ ID NO: 3271 - DNA, 976 bp, synthetic construct; identical to SEQ ID NO: 2334
  misc_feature 1..976: note = Synthetic polypeptide
  source 1..976: mol_type = other DNA

SEQ ID NO: 3272 - DNA, 1009 bp, synthetic construct; identical to SEQ ID NO: 2335
  misc_feature 1..1009: note = Synthetic polypeptide
  source 1..1009: mol_type = other DNA

SEQ ID NO: 3273 - DNA, 1132 bp, synthetic construct; identical to SEQ ID NO: 2336
  misc_feature 1..1132: note = Synthetic polypeptide
  source 1..1132: mol_type = other DNA

SEQ ID NO: 3274 - DNA, 563 bp, synthetic construct; identical to SEQ ID NO: 2337
  misc_feature 1..563: note = Synthetic polypeptide
  source 1..563: mol_type = other DNA

SEQ ID NO: 3275 - DNA, 1358 bp, synthetic construct; identical to SEQ ID NO: 2339
  misc_feature 1..1358: note = Synthetic polypeptide
  source 1..1358: mol_type = other DNA

SEQ ID NO: 3276 - DNA, 1913 bp, synthetic construct
  misc_feature 1..1913: note = Synthetic polypeptide
  source 1..1913: mol_type = other DNA
tgtgtagctactgcagcacagatctgtactccctttggtcggctgttggctgctttcctgaggcttccatccgtctctttgctgccgagttggtgctggtactgtgttatctccatgacttgggcatcatgcatcgagatgtgaagatggagaatattcttctagatgaacgagctggactgtgctgctgccatctcggctcactgcaacctccctgcctgattctcctgactcagcctgtcgagtgcctgcgattgcaggcgcgcggcgccatgcctgactggttttcgtatttttttggtggagacggggtttcgctgtgttggccggactggtctccagctcctaactgcgagtgatccgccagcctcggcctcccgaggtgccgggattgcagacggagtctcgttaactcagtgctcagtggtgcccaggctggagtgcagtggcgtgatctcggctcgctacaacctccacctcccagccgcctgccttggccccccaaagtgccgagattgcagcctctgcccggacgccaccccgtctgggaagtgaggagcgtctctgcctggccgcccatcgtctgggatgtgaggagcccctctgcctggctgcccagtctggaaggtgaggagcgtctctgcccggccgccatcccacctaggaagtgaggagcacctcttcccggccaccatcccatctaggaagtgaggagcgtctctgcccggctgcccatcgtctgagatgtggggagcgcctctgccccgccgccccgtctgggatgtgaggagcgccttggcccggccgtgaccccgtctgggaggtgaggagcgtctctgcccggccaccccgtctgagaagtgaggagaccctccgcccggcaactgccccgtctgagaagtgaggagcccctccgcccggcagccgccccgtctgagaagtgaggagcccctccgcccggctgccaccccgtctgggaagtgaggagcgtctccgcccagcagccaccccgtccgggagggaggtgggggtcagcccccgccaggccagctgccccatccgggagggaggtggggtgtcagccccctgcccggccagccgccccgtccgggaggtgaggggcgcctctgcccggctgcccctactgggaagtgaggagcccctctgcccggccagccgccccgtccgggagggaggtgggggagtcagccccccgcccggccagccgccccttccaggagggaggtggggggttcagcccaccgcccggccagccgccccgtccgggagggaggtgggggggtcagccccccgcccggccagccgccccgtctgggaggtgaggggcgcctctgcccggctgcccctgctgggaagtgaggagcccctctgctgggccaccaccccgtctgggaggtgtacccagcagctcattgagaacgggccatgatgacaatggcggttttgtggaatagaaaggggggaaaggtggggaaaagattgagaaatcggatggttgctgtgtctgtgtagagggaggtagacatgggagacttttcattttgttctgtactaagaaaaattcttctgccttgggatcctgttgatctatgaccttacccccaaccctgtgctctctaaaacatgtgctgtgtccactcagggttaaatggattaagggcggtgcaagatgtgctttgttaaacagatgcttgaaggcagcatgcttgttaagagtcatcaccactccctaatcgcaagtacccagggacacaaacactctgcctaggaaaaccagagacctttgttcacttgtttatctgctgaccttccttccactattgtcctatgaccctgccaaatccccctctgcgagaaacacccaagaatgatcaataaaaaataaaataaaa

SEQ ID NO: 3277 - DNA, 2460 bp, synthetic construct
  misc_feature 1..2460: note = Synthetic polypeptide
  source 1..2460: mol_type = other DNA
atgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccagcgacagatcaaccatccctttgtacacagcttgggggacagctggcagggaaaacggcaccttttcattatgtgtagctactgcagcacagatctgtactccctttggtcggctgttggctgctttcctgaggcttccatccgtctctttgctgccgagttggtgctggtactgtgttatctccatgacttgggcatcatgcatcgagatgtgaagatggagaatattcttctagatgaacgagctggactgtgctgctgccatctcggctcactgcaacctccctgcctgattctcctgactcagcctgtcgagtgcctgcgattgcaggcgcgcggcgccatgcctgactggttttcgtatttttttggtggagacggggtttcgctgtgttggccggactggtctccagctcctaactgcgagtgatccgccagcctcggcctcccgaggtgccgggattgcagacggagtctcgttaactcagtgctcagtggtgcccaggctggagtgcagtggcgtgatctcggctcgctacaacctccacctcccagccgcctgccttggccccccaaagtgccgagattgcagcctctgcccggacgccaccccgtctgggaagtgaggagcgtctctgcctggccgcccatcgtctgggatgtgaggagcccctctgcctggctgcccagtctggaaggtgaggagcgtctctgcccggccgccatcccacctaggaagtgaggagcacctcttcccggccaccatcccatctaggaagtgaggagcgtctctgcccggctgcccatcgtctgagatgtggggagcgcctctgccccgccgccccgtctgggatgtgaggagcgccttggcccggccgtgaccccgtctgggaggtgaggagcgtctctgcccggccaccccgtctgagaagtgaggagaccctccgcccggcaactgccccgtctgagaagtgaggagcccctccgcccggcagccgccccgtctgagaagtgaggagcccctccgcccggctgccaccccgtctgggaagtgaggagcgtctccgcccagcagccaccccgtccgggagggaggtgggggtcagcccccgccaggccagctgccccatccgggagggaggtggggtgtcagccccctgcccggccagccgccccgtccgggaggtgaggggcgcctctgcccggctgcccctactgggaagtgaggagcccctctgcccggccagccgccccgtccgggagggaggtgggggagtcagccccccgcccggccagccgccccttccaggagggaggtggggggttcagcccaccgcccggccagccgccccgtccgggagggaggtgggggggtcagccccccgcccggccagccgccccgtctgggaggtgaggggcgcctctgcccggctgcccctgctgggaagtgaggagcccctctgctgggccaccaccccgtctgggaggtgtacccagcagctcattgagaacgggccatgatgacaatggcggttttgtggaatagaaaggggggaaaggtggggaaaagattgagaaatcggatggttgctgtgtctgtgtagagggaggtagacatgggagacttttcattttgttctgtactaagaaaaattcttctgccttgggatcctgttgatctatgaccttacccccaaccctgtgctctctaaaacatgtgctgtgtccactcagggttaaatggattaagggcggtgcaagatgtgctttgttaaacagatgcttgaaggcagcatgcttgttaagagtcatcaccactccctaatcgcaagtacccagggacacaaacactctgcctaggaaaaccagagacctttgttcacttgtttatctgctgaccttccttccactattgtcctatgaccctgccaaatccccctctgcgagaaacacccaagaatgatcaataaaaaataaaataaaa

SEQ ID NO: 3278 - DNA, 3961 bp, synthetic construct; identical to SEQ ID NO: 1670
  misc_feature 1..3961: note = Synthetic polypeptide
  source 1..3961: mol_type = other DNA

SEQ ID NO: 3279 - DNA, 483 bp, synthetic construct; identical to SEQ ID NO: 2246
  misc_feature 1..483: note = Synthetic polypeptide
  source 1..483: mol_type = other DNA

SEQ ID NO: 3280 - DNA, 4277 bp, synthetic construct; identical to SEQ ID NO: 2069
  misc_feature 1..4277: note = Synthetic polypeptide
  source 1..4277: mol_type = other DNA

SEQ ID NO: 3281 - DNA, 934 bp, synthetic construct
  misc_feature 1..934: note = Synthetic polypeptide
  source 1..934: mol_type = other DNA
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcatggtgttccaaacacagggacatggatgaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3282 - DNA, 937 bp, synthetic construct
  misc_feature 1..937: note = Synthetic polypeptide
  source 1..937: mol_type = other DNA
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagcagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcatggtgttccaaacacagggacatggatgaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3283 - DNA, 767 bp, synthetic construct
  misc_feature 1..767: note = Synthetic polypeptide
  source 1..767: mol_type = other DNA
atgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcatttctcctttaggttctgcatactaacaaaactactgatgccagccattctgaaagtcttggcaagaaactcacttagggaggactgtagtttccatatcctgatgatttcagtccctgacctgaatcaattgatgacctcaatttccagcccctcacccttcaaagactcttgcccagaaacccttaatgaaatgggtttgagttttgagaattcttcccaagtccttgcttggtgaccttgcaattagtaagttctttctctgttgcaaaccccacagtctcggtgtattgttctgtagctgtgcagccggcatagaaacctgacagtcttgtaa

SEQ ID NO: 3284 - DNA, 461 bp, synthetic construct
  misc_feature 1..461: note = Synthetic polypeptide
  source 1..461: mol_type = other DNA
atggccttaaagagcacaagtatcggcctttgtcttagtcaagctttcgaggagcaactcagcaattctgttaccgataatcacctaacagtttacacattcaaaaccactgggaagccacagaccaggcaccgtgggatggggaagtggagaccgagaggctgctgccggggaaatatgcagtgcagacaagagggtaatgggtgtcccgatctcgcgggggactctgtgatccgtgttcccctgaccctcctagtgcacaacttggccgggctcactgggctcctgcaccactgcctgtcaggcacatcctcaccctcggagcctccttctcctcacctgcaagacagaggtgacagggctcacctctcaaggctgctgagcgggctggacgctactgcttagatgcaacctccttgcaaactgtagagtgctctgagaaggtcagttgttgtcactgt

SEQ ID NO: 3285 - DNA, 1673 bp, synthetic construct
  misc_feature 1..1673: note = Synthetic polypeptide
  source 1..1673: mol_type = other DNA
atgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcatttctcctttaggttctgcatactaacaaaactactgatgccagccattctgaaagtcttggcaagaaactcacttagggaggactgtagtttccatatcctgatgatttcagtccctgacctgaatcaattgatgacctcaatttccagcccctcacccttcaaagactcttgcccagaaacccttaatgaaatgggtttgagttttgagaattcttcccaagtccttgcttggtgaccttgcaattagtaagttctttctctgttgcaaaccccacagtctcggtgtattgttctgtagctgtgcagccggcatagaaacctgacagtcttgtaa

SEQ ID NO: 3286 - DNA, 1481 bp, synthetic construct
  misc_feature 1..1481: note = Synthetic polypeptide
  source 1..1481: mol_type = other DNA
atgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcatttctcctttaggttctgcatactaacaaaactactgatgccagccattctgaaagtcttggcaagaaactcacttagggaggactgtagtttccatatcctgatgatttcagtccctgacctgaatcaattgatgacctcaatttccagcccctcacccttcaaagactcttgcccagaaacccttaatgaaatgggtttgagttttgagaattcttcccaagtccttgcttggtgaccttgcaattagtaagttctttctctgttgcaaaccccacagtctcggtgtattgttctgtagctgtgcagccggcatagaaacctgacagtcttgtaa

SEQ ID NO: 3287 - DNA, 1596 bp, synthetic construct
  misc_feature 1..1596: note = Synthetic polypeptide
  source 1..1596: mol_type = other DNA
atgatccagttgacagctacccctgtgagtgcacttgttgatgagccagtgcatatccgagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggcacagactgccaaggctgggggcaacatatctgtatcaaaagaggaagcttggaaaccggtaggaccttgacgccaggtggcctcaaatctccacttcctgcattctgctgcaatgctcctcacctgccccaggtatggttcacgcaggcccatgtgcagtttgggccactctctggaaggcaatatagtaaatcttggtggtgtctgtgcagtgctatctctaccaaagtgcagagtgcacaagtcatgagggcatgcctgcctccacttagatttcaaaggatgccccagaaagcctcagagcccagacagagaactatcacaggagcaggaccaccacagacagcccccaccccagtatggcaatgcccagtgaaaccgtgggagcagagccacccccaagaccccagactggtagagccaccagtgtgcaattccagcctgggagagccataggcatgtgactccaatatgtgagaaatgctatatgggttttgcccagcaaagtcatggccaggactaccccccaccccccaagtgtttagaaggtaaaatgtcaagtcgaagattattcttgagccttaatatttgccctgttgggttttacagttagtcaggatttattatctttttcttccttcctacttctaccttttggaaaggaaatgtctgccctgtgcctatcccaccattgtattttcaaagcatgtaacttgtttgatttcagaggctcacagctgaaggggaatttgcctcaggatgagtcacacctttgagtctcagtcatatttgatttaaatgagactttggacctcagacttttgaattggtgctggaacaagttaaggcctggggagctactgggatggaatgaatacattctgcatgtgagaagaacatacatttcggacggccagaagcagaa

SEQ ID NO: 3288 - DNA, 881 bp, synthetic construct; identical to SEQ ID NO: 2412
  misc_feature 1..881: note = Synthetic polypeptide
  source 1..881: mol_type = other DNA

SEQ ID NO: 3289 - DNA, 803 bp, synthetic construct; identical to SEQ ID NO: 2413
  misc_feature 1..803: note = Synthetic polypeptide
  source 1..803: mol_type = other DNA

SEQ ID NO: 3290 - DNA, 5929 bp, synthetic construct
  misc_feature 1..5929: note = Synthetic polypeptide
  source 1..5929: mol_type = other DNA
atgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagaatgcagctcctcgccagcaacggaacaaagctggacggagaatgactttgacgagttgagagaagaaggcttcagatgattggtaataacagacttctctgagctaaaggaaggtgttggaacccatcgccagaaagctaaaaaccttgataaaagattagatgatggctaactagaataaacagcatagagaagaccctaaatgacctgatggagctgaaaaccatgacatgagaaatacgtgatgcatgaacaagcttcagtagctgattcgatcaagtggaggaaagggtatcagtgattgaagatcaaatgaatgaaatgaagtgagaagagaagtttagagaaaaaagagtaaaaagaaatgaacaaagcctccaagaaatatgggactatgtgaaaagaccaaatctacgtctgattgtacctgaaagtgacagggagaatggaaccaagttggaaaacatgctgcaggatattatccaggagaatttccccaacctaccaacgcaggccaacattcaaattcaggaaatacagagaaggctacaaagatactccctgagaagagcaactccaagacacataattgtcagattgactaaagttgaaatgaggaaaaaatgctaagggcagacagagagaaaggtcaggttacccacaaagggaagcccatcagactaacagtggatctctcagcagaaactacaagtcagaagaaagtgggggccaatattcaacattcttaaagaaaataatttttaacctagaatttcatatccagccaaactaagcttcataagtgaaggagaaataaaatactttacagacaagcaaatgctgagattttgtcaccaccaggcctgccttacaagaactcctgaaggaagcactaaacatggaaaggaacaaccggtaccagccactgcaaaaacaggccaaattgtagagaccatcaatgctacaaaaaaactgcatcaactaacgagcaaaataaccagctgacatcataatgacaggatcaaattcacacataacaatattaaccttaaatgtaaatgggctaaatgctccaattaaaagacacagactggcaaattggataaagagtcaagacccatcagtgtgctgtatttaggagacccatctcacatgcagagacacacataggctcaaaataaaggcatggaggaaaccctaccaagcaaatggaaaacaaaaaaaaagcaggggttgcaatcctagtctctgataaaacagactttaaaccaacaaagatcagaagagagaaagaaggccattacatattggtaaagggatcaattcaacaagaagagctaactatcctaaatatatttgcacccaatacaggagcacccagattcataaagcaagtccttagagacctacaaagagacttagactcccacacaataataatgggagactttaacgccccactgtcaatattagacagaacaacaagacagaaagttaacaaggatatccaggaattgaactcagctctgcaccaagcagacctaatagacatctacagaactctccacctcaaatcaacagaatatatattctttttagcaccacatctcacttattccaaaattgaccacataggtggaagtaaagcactcctcagcaaatgtaaaagaacagaaattataacaaactgtctctcagaccacagtgcaatcaaacgacaactcaggtttaagaaactcactcaaaaccgctcaactacatggaaactgaacaacctgttcctgaatgactactgggtacataacgaaatgaaggcagaaataaagatgttctttgaagccaatgagaacaaagacacaacataccagaatctctgggacacatttaaagcagtgtgtagagggaaatttatagcactaaatgcccacaagagaaagcagggaagatctaaaatgggcaccctaacatcacaattaaaagaactagagaagcaagagcaaacacattcaaaagctagcagaaggcaagaaagtactaagatcagagcagaactgaaggagatagagacacaaaaaacccttcaaaaaatcaatgaatccaggagctgttttttttgaaaagaccaaaaaaattgatagaccgctagcaagactaataaagaagaaaagagtgaagaatcaaatagatgcaataaaaaatgataaaggggatatcaccacctatcccacagagatacaaactcccatcagagaatactataaacaccactatgcagataaactagaaaatctagaagaaatggatacattcctgtacacatacactctcccaagactaaacctggaagaagttgaatccctgaatacaccaataacacactctgaaattgaggcaataattaaaagcctactaaccaaaaaaagtccaggaccagacagattcacagccaaattccaccagaggtacaaagaggagctggtaccattccttctgaaactattccaatcaatagaaaaagaggtaatcctccctgactcattttatgaggccagcatcatcctgatacgaaagcctggcagagatacaacaacaaaaaaagagaattttagaccaatattcctgatgaacattgatgcaaaaaacttcagtaaaatactggcaaaccaaatccagcagcacatcaaaaaggttatccaccacgatcaagtgggcctcatccctgggatgcaaggctggttcaacatacccaaatcaataaacataatccatcatataaacagaaccaaagacaaaaaccacatgattatctcaatagatgcagaaaaggccttcgacaaaattcaactgcccttcatgctaaaaactctcagtaaactaggtattgatgggacatgcctcaaaataataagagctatttatgacaaacccacagccagggggcaaaatctggaagcattccctttgaaaactggcacaagacagggatgccctctctcaccactcctattcaacatagtgttggaagttctggtcagggcagtcaggcaggagaaataaataaagggtattcaattaggaaaagagaaagtcaaattgtacctgtttgcagatgacatgattgtatatttagaaaaccccatcatctcagcccaaaacctccttaagctgataagcaacttcagcaaagtctcaggatacaaaatcaatgtgcaaaaatcacaagcattttttacaccaataacagacaagcagagagccaaatcatgagtgaactcccattcacaattgcttcaaagagaataaaatacctaggaatccaacttacaagggatgtgaagtacctcttcaaggagaactacaaaccactgctcagtaaaattaaagaggacacaaacaaatggaagaacattccatgctcatggataggaagaatcaatgtgtgaaaatggccacactgcccaaggtaatttatagattcagtgccatccccatcaagctaccaatgactttcttcacagaattggaaaaaactacttttaaagttcatatggaaccaaaaaagagcccacattgccaagacaatcctaagccaaaagaacaaagctggcatcatcacactacctgacttcaaactatactacaaggctacagtaaccaaaacagcatggtacggtaccaaaacagagatatagaccaacggaacagaacagagccctcagaaataataccacacatctacaaccatctgatctttgagaagcctgacaaatacaagaaatggggaaaggattccctgtttaataaatggtgctgggaaaactggctagccatatgtagaaagctgaaactggatgccttccttactccttatacaaaaattaattcaagatggattaaagacttaaatgttagacctgaaactataaacaccctagaagaaaacctaggcaatgccattcaggacataggcatggacaaggacttcatgactaaaacaccaaaagcaatggccacaaaagccaaaatagacaaatgagatctaattaaactaaagagcctctgcacagcaaaagaaactaccatcagagtgaacaggcaacctacagaatgggagaaaatgtttacaatctacccatctgacaaagggctaatatccagaatctacaaagaacttaaatttacaagaaaaaatcaaacaaccccatcacaaagtgggcaaagtgtatgaacagacacctctcaaaagaagatatttatgcagccaacagacacatgaaaaaatgctcatcatcactggccatcagagaaatgcaaatcaaaaccacagtgagataccatctcacaccagttagaatggtgttcattaaagattcaggaaacaacaggtgctggagaggatgtggaaaaataggaacacttttacgctgttggtgggactgtaaactagttaaaccattgtggaagacagtgtggtgattcctcaagggtctagaactagaaataccatttgacccagccatcccattactgggtatataccgaaagaattataaatcatggtgctataaagacacatgcacacgtatgtttattgcactactattcacaatagcaaagacttggaaccaacccagatgtctatcaatgatagactggattaagaaaatgtggcacatatacatcatggaatactatgcagacataaaaaaggatgagttcatgtcctttgtagggacatggatgaagctggaaaccatgattctgagcaaactctcacaaagacagaaaaccaaacaccgcatgttctcactcataagtgggaattgaacaatgaaaacacttggacacagggtggtgaacatcacacatgggggcccgtcgtggggtgggaggagcggggagggatagtattagcagatatacctaatgtaaatgacgagttaatgcgtgcagcacaccaacatggcacatgtatacatatgtaacaaacctgcacattgtgcacattcaccctagaacttcaagtataattaaaaaaaaaa

SEQ ID NO: 3291 - DNA, 5902 bp, synthetic construct
  misc_feature 1..5902: note = Synthetic polypeptide
  source 1..5902: mol_type = other DNA
atgtcaggactggggaagaagcatctcctgctcatgggggagtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagaatgcagctcctcgccagcaacggaacaaagctggacggagaatgactttgacgagttgagagaagaaggcttcagatgattggtaataacagacttctctgagctaaaggaaggtgttggaacccatcgccagaaagctaaaaaccttgataaaagattagatgatggctaactagaataaacagcatagagaagaccctaaatgacctgatggagctgaaaaccatgacatgagaaatacgtgatgcatgaacaagcttcagtagctgattcgatcaagtggaggaaagggtatcagtgattgaagatcaaatgaatgaaatgaagtgagaagagaagtttagagaaaaaagagtaaaaagaaatgaacaaagcctccaagaaatatgggactatgtgaaaagaccaaatctacgtctgattgtacctgaaagtgacagggagaatggaaccaagttggaaaacatgctgcaggatattatccaggagaatttccccaacctaccaacgcaggccaacattcaaattcaggaaatacagagaaggctacaaagatactccctgagaagagcaactccaagacacataattgtcagattgactaaagttgaaatgaggaaaaaatgctaagggcagacagagagaaaggtcaggttacccacaaagggaagcccatcagactaacagtggatctctcagcagaaactacaagtcagaagaaagtgggggccaatattcaacattcttaaagaaaataatttttaacctagaatttcatatccagccaaactaagcttcataagtgaaggagaaataaaatactttacagacaagcaaatgctgagattttgtcaccaccaggcctgccttacaagaactcctgaaggaagcactaaacatggaaaggaacaaccggtaccagccactgcaaaaacaggccaaattgtagagaccatcaatgctacaaaaaaactgcatcaactaacgagcaaaataaccagctgacatcataatgacaggatcaaattcacacataacaatattaaccttaaatgtaaatgggctaaatgctccaattaaaagacacagactggcaaattggataaagagtcaagacccatcagtgtgctgtatttaggagacccatctcacatgcagagacacacataggctcaaaataaaggcatggaggaaaccctaccaagcaaatggaaaacaaaaaaaaagcaggggttgcaatcctagtctctgataaaacagactttaaaccaacaaagatcagaagagagaaagaaggccattacatattggtaaagggatcaattcaacaagaagagctaactatcctaaatatatttgcacccaatacaggagcacccagattcataaagcaagtccttagagacctacaaagagacttagactcccacacaataataatgggagactttaacgccccactgtcaatattagacagaacaacaagacagaaagttaacaaggatatccaggaattgaactcagctctgcaccaagcagacctaatagacatctacagaactctccacctcaaatcaacagaatatatattctttttagcaccacatctcacttattccaaaattgaccacataggtggaagtaaagcactcctcagcaaatgtaaaagaacagaaattataacaaactgtctctcagaccacagtgcaatcaaacgacaactcaggtttaagaaactcactcaaaaccgctcaactacatggaaactgaacaacctgttcctgaatgactactgggtacataacgaaatgaaggcagaaataaagatgttctttgaagccaatgagaacaaagacacaacataccagaatctctgggacacatttaaagcagtgtgtagagggaaatttatagcactaaatgcccacaagagaaagcagggaagatctaaaatgggcaccctaacatcacaattaaaagaactagagaagcaagagcaaacacattcaaaagctagcagaaggcaagaaagtactaagatcagagcagaactgaaggagatagagacacaaaaaacccttcaaaaaatcaatgaatccaggagctgttttttttgaaaagaccaaaaaaattgatagaccgctagcaagactaataaagaagaaaagagtgaagaatcaaatagatgcaataaaaaatgataaaggggatatcaccacctatcccacagagatacaaactcccatcagagaatactataaacaccactatgcagataaactagaaaatctagaagaaatggatacattcctgtacacatacactctcccaagactaaacctggaagaagttgaatccctgaatacaccaataacacactctgaaattgaggcaataattaaaagcctactaaccaaaaaaagtccaggaccagacagattcacagccaaattccaccagaggtacaaagaggagctggtaccattccttctgaaactattccaatcaatagaaaaagaggtaatcctccctgactcattttatgaggccagcatcatcctgatacgaaagcctggcagagatacaacaacaaaaaaagagaattttagaccaatattcctgatgaacattgatgcaaaaaacttcagtaaaatactggcaaaccaaatccagcagcacatcaaaaaggttatccaccacgatcaagtgggcctcatccctgggatgcaaggctggttcaacatacccaaatcaataaacataatccatcatataaacagaaccaaagacaaaaaccacatgattatctcaatagatgcagaaaaggccttcgacaaaattcaactgcccttcatgctaaaaactctcagtaaactaggtattgatgggacatgcctcaaaataataagagctatttatgacaaacccacagccagggggcaaaatctggaagcattccctttgaaaactggcacaagacagggatgccctctctcaccactcctattcaacatagtgttggaagttctggtcagggcagtcaggcaggagaaataaataaagggtattcaattaggaaaagagaaagtcaaattgtacctgtttgcagatgacatgattgtatatttagaaaaccccatcatctcagcccaaaacctccttaagctgataagcaacttcagcaaagtctcaggatacaaaatcaatgtgcaaaaatcacaagcattttttacaccaataacagacaagcagagagccaaatcatgagtgaactcccattcacaattgcttcaaagagaataaaatacctaggaatccaacttacaagggatgtgaagtacctcttcaaggagaactacaaaccactgctcagtaaaattaaagaggacacaaacaaatggaagaacattccatgctcatggataggaagaatcaatgtgtgaaaatggccacactgcccaaggtaatttatagattcagtgccatccccatcaagctaccaatgactttcttcacagaattggaaaaaactacttttaaagttcatatggaaccaaaaaagagcccacattgccaagacaatcctaagccaaaagaacaaagctggcatcatcacactacctgacttcaaactatactacaaggctacagtaaccaaaacagcatggtacggtaccaaaacagagatatagaccaacggaacagaacagagccctcagaaataataccacacatctacaaccatctgatctttgagaagcctgacaaatacaagaaatggggaaaggattccctgtttaataaatggtgctgggaaaactggctagccatatgtagaaagctgaaactggatgccttccttactccttatacaaaaattaattcaagatggattaaagacttaaatgttagacctgaaactataaacaccctagaagaaaacctaggcaatgccattcaggacataggcatggacaaggacttcatgactaaaacaccaaaagcaatggccacaaaagccaaaatagacaaatgagatctaattaaactaaagagcctctgcacagcaaaagaaactaccatcagagtgaacaggcaacctacagaatgggagaaaatgtttacaatctacccatctgacaaagggctaatatccagaatctacaaagaacttaaatttacaagaaaaaatcaaacaaccccatcacaaagtgggcaaagtgtatgaacagacacctctcaaaagaagatatttatgcagccaacagacacatgaaaaaatgctcatcatcactggccatcagagaaatgcaaatcaaaaccacagtgagataccatctcacaccagttagaatggtgttcattaaagattcaggaaacaacaggtgctggagaggatgtggaaaaataggaacacttttacgctgttggtgggactgtaaactagttaaaccattgtggaagacagtgtggtgattcctcaagggtctagaactagaaataccatttgacccagccatcccattactgggtatataccgaaagaattataaatcatggtgctataaagacacatgcacacgtatgtttattgcactactattcacaatagcaaagacttggaaccaacccagatgtctatcaatgatagactggattaagaaaatgtggcacatatacatcatggaatactatgcagacataaaaaaggatgagttcatgtcctttgtagggacatggatgaagctggaaaccatgattctgagcaaactctcacaaagacagaaaaccaaacaccgcatgttctcactcataagtgggaattgaacaatgaaaacacttggacacagggtggtgaacatcacacatgggggcccgtcgtggggtgggaggagcggggagggatagtattagcagatatacctaatgtaaatgacgagttaatgcgtgcagcacaccaacatggcacatgtatacatatgtaacaaacctgcacattgtgcacattcaccctagaacttcaagtataattaaaaaaaaaa

SEQ ID NO: 3292 - DNA, 518 bp, synthetic construct; identical to SEQ ID NO: 1648
  misc_feature 1..518: note = Synthetic polypeptide
  source 1..518: mol_type = other DNA

SEQ ID NO: 3293 - DNA, 510 bp, synthetic construct; identical to SEQ ID NO: 1633
  misc_feature 1..510: note = Synthetic polypeptide
  source 1..510: mol_type = other DNA

SEQ ID NO: 3294 - DNA, 952 bp, synthetic construct
  misc_feature 1..952: note = Synthetic polypeptide
  source 1..952: mol_type = other DNA
atgacgacttacagtgacaaaggggcaaagcctgagagaggccgattcctccacttccactctgtgaccttctgggttggcaacgccaagcaggccacgtcattctactgcagcaagatgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcggaggctgaagcaggagaatcgcttgaaccgggaggcagaggttgcagtgagctaagatcgtgccactgcactccagcctgggcaacagagactccatctcaaaaaaaaagaaaaaaagaaa

SEQ ID NO: 3295 - DNA, 835 bp, synthetic construct
  misc_feature 1..835: note = Synthetic polypeptide
  source 1..835: mol_type = other DNA
atgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcggaggctgaagcaggagaatcgcttgaaccgggaggcagaggttgcagtgagctaagatcgtgccactgcactccagcctgggcaacagagactccatctcaaaaaaaaagaaaaaaagaaa

SEQ ID NO: 3296 - DNA, 209 bp, synthetic construct; identical to SEQ ID NO: 2913
  misc_feature 1..209: note = Synthetic polypeptide
  source 1..209: mol_type = other DNA

SEQ ID NO: 3297 - DNA, 1091 bp, synthetic construct; identical to SEQ ID NO: 2614
  misc_feature 1..1091: note = Synthetic polypeptide
  source 1..1091: mol_type = other DNA

SEQ ID NO: 3298 - DNA, 1118 bp, synthetic construct; identical to SEQ ID NO: 2615
  misc_feature 1..1118: note = Synthetic polypeptide
  source 1..1118: mol_type = other DNA

SEQ ID NO: 3299 - DNA, 1325 bp, synthetic construct; identical to SEQ ID NO: 2616
  misc_feature 1..1325: note = Synthetic polypeptide
  source 1..1325: mol_type = other DNA

SEQ ID NO: 3300 - DNA, 1229 bp, synthetic construct; identical to SEQ ID NO: 2617
  misc_feature 1..1229: note = Synthetic polypeptide
  source 1..1229: mol_type = other DNA

SEQ ID NO: 3301 - DNA, 2721 bp, synthetic construct; identical to SEQ ID NO: 962
  misc_feature 1..2721: note = Synthetic polypeptide
  source 1..2721: mol_type = other DNA

SEQ ID NO: 3302 - DNA, 2549 bp, synthetic construct; identical to SEQ ID NO: 963
  misc_feature 1..2549: note = Synthetic polypeptide
  source 1..2549: mol_type = other DNA

SEQ ID NO: 3303 - DNA, 1490 bp, synthetic construct; identical to SEQ ID NO: 1677
  misc_feature 1..1490: note = Synthetic polypeptide
  source 1..1490: mol_type = other DNA

SEQ ID NO: 3304 - DNA, 1451 bp, synthetic construct; identical to SEQ ID NO: 1678
  misc_feature 1..1451: note = Synthetic polypeptide
  source 1..1451: mol_type = other DNA

SEQ ID NO: 3305 - DNA, 926 bp, synthetic construct; identical to SEQ ID NO: 1679
  misc_feature 1..926: note = Synthetic polypeptide
  source 1..926: mol_type = other DNA

SEQ ID NO: 3306 - DNA, 1451 bp, synthetic construct; identical to SEQ ID NO: 1680
  misc_feature 1..1451: note = Synthetic polypeptide
  source 1..1451: mol_type = other DNA

SEQ ID NO: 3307 - DNA, 690 bp, synthetic construct; identical to SEQ ID NO: 2745
  misc_feature 1..690: note = Synthetic polypeptide
  source 1..690: mol_type = other DNA

SEQ ID NO: 3308 - DNA, 690 bp, synthetic construct; identical to SEQ ID NO: 2746
  misc_feature 1..690: note = Synthetic polypeptide
  source 1..690: mol_type = other DNA

SEQ ID NO: 3309 - DNA, 825 bp, synthetic construct; identical to SEQ ID NO: 2747
  misc_feature 1..825: note = Synthetic polypeptide
  source 1..825: mol_type = other DNA

SEQ ID NO: 3310 - DNA, 960 bp, synthetic construct
  misc_feature 1..960: note = Synthetic polypeptide
  source 1..960: mol_type = other DNA
atgacgacttacagtgacaaaggggcaaagcctgagagaggccgattcctccacttccactctgtgaccttctgggttggcaacgccaagcaggccacgtcattctactgcagcaagatgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgctactcaggaggctgaagcaggagaatcgcttgaaccgggaggcagaggttgcagtgagctaagatcgtgccactgcactccagcctgggcaacagagactccatctcaaaaaaaaagaaaaaaagaaa

SEQ ID NO: 3311 - DNA, 843 bp, synthetic construct
  misc_feature 1..843: note = Synthetic polypeptide
  source 1..843: mol_type = other DNA
atgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgctactcaggaggctgaagcaggagaatcgcttgaaccgggaggcagaggttgcagtgagctaagatcgtgccactgcactccagcctgggcaacagagactccatctcaaaaaaaaagaaaaaaagaaa

SEQ ID NO: 3312 - DNA, 2570 bp, synthetic construct
  misc_feature 1..2570: note = Synthetic polypeptide
  source 1..2570: mol_type = other DNA
atggcaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccaggtgcatccctgcctatccttagcttggaacacctctcatgggggactttttgcccgcaggatctctcccctgcagcagctcagaccctaccagatacaggcctccaggctccaccccacccagagctcctgaccgcacagccagcggcactggacacttccacctggatgtcccccaggcccttcaaactcaa

SEQ ID NO: 3313 - DNA, 2540 bp, synthetic construct
  misc_feature 1..2540: note = Synthetic polypeptide
  source 1..2540: mol_type = other DNA
atgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccaggtgcatccctgcctatccttagcttggaacacctctcatgggggactttttgcccgcaggatctctcccctgcagcagctcagaccctaccagatacaggcctccaggctccaccccacccagagctcctgaccgcacagccagcggcactggacacttccacctggatgtcccccaggcccttcaaactcaa

SEQ ID NO: 3314 - DNA, 2237 bp, synthetic construct
  misc_feature 1..2237: note = Synthetic polypeptide
  source 1..2237: mol_type = other DNA
atgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccaggtgcatccctgcctatccttagcttggaacacctctcatgggggactttttgcccgcaggatctctcccctgcagcagctcagaccctaccagatacaggcctccaggctccaccccacccagagctcctgaccgcacagccagcggcactggacacttccacctggatgtcccccaggcccttcaaactcaa

SEQ ID NO: 3315 - DNA, 514 bp, synthetic construct; identical to SEQ ID NO: 1674
  misc_feature 1..514: note = Synthetic polypeptide
  source 1..514: mol_type = other DNA

SEQ ID NO: 3316 - DNA, 419 bp, synthetic construct
  misc_feature 1..419: note = Synthetic polypeptide
  source 1..419: mol_type = other DNA
atggggaggaagctggacctgtctggtttgactgatgatgaaacagagcatgttcttcaggtggttcaaagagacttcaatcttcgcaaaaaagaagaagaacgactaaggaacatggatgaagctggaaaccatcattctcagcaaactgtcacaagatcagaaaaccaaacactgcatgttctcactcataagtgggagttgaacgaagaacacatggacacaggaaggggaacatcacacactggggcctgtcggggagtgtggggctacgggagggataacattaggagaaatacctaatgtaagtgacaggttgatgggtgcaacaaaccaccagggcacatgtatacctatgtaacaaaactgcacattctgtatgtgtaacccagaacttaaagtataataaaataaataaa

SEQ ID NO: 3317 - DNA, 1092 bp, synthetic construct
  misc_feature 1..1092: note = Synthetic polypeptide
  source 1..1092: mol_type = other DNA
atgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaata

SEQ ID NO: 3318 - DNA, 795 bp, synthetic construct
  misc_feature 1..795: note = Synthetic polypeptide
  source 1..795: mol_type = other DNA
atgccacagtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaata

SEQ ID NO: 3319 - DNA, 1382 bp, synthetic construct; identical to SEQ ID NO: 1251
  misc_feature 1..1382: note = Synthetic polypeptide
  source 1..1382: mol_type = other DNA

SEQ ID NO: 3320 - DNA, 5235 bp, synthetic construct
  misc_feature 1..5235: note = Synthetic polypeptide
  source 1..5235: mol_type = other DNA
atgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggttgagcatcccaaatctgaaaatccaaaatctgaaatgcttcaaaatttgaaactttttgagtaccaacatgacaccacaaatgaaaaattccacacataagtacttaacacaaactttgtttcatgtaaaacattgtttaaaacattgtataaaattacctttaggggatgtatataaggtatacatgaaacataaatgaattttgtatttagacatggtcccatccccaagatatcttattgtatgtatatgcaaatattccaaaatctgaaaaaaatctgaaatctgaaacacttctggttccaagcattttggataaggattactcaac

SEQ ID NO: 3321 - DNA, 2564 bp, synthetic construct
  misc_feature 1..2564: note = Synthetic polypeptide
  source 1..2564: mol_type = other DNA
cagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaagagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccg

SEQ ID NO: 3322 - DNA, 3077 bp, synthetic construct
  misc_feature 1..3077: note = Synthetic polypeptide
  source 1..3077: mol_type = other DNA
atgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctcccccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccg

SEQ ID NO: 3323 - DNA, 3038 bp, synthetic construct
  misc_feature 1..3038: note = Synthetic polypeptide
  source 1..3038: mol_type = other DNA
atgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctcccccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccg

SEQ ID NO: 3324 - DNA, 748 bp, synthetic construct
  misc_feature 1..748: note = Synthetic polypeptide
  source 1..748: mol_type = other DNA
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgggacatggatgaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3325 - DNA, 751 bp, synthetic construct
  misc_feature 1..751: note = Synthetic polypeptide
  source 1..751: mol_type = other DNA
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagcagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgggacatggatgaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3326 - DNA, 472 bp, synthetic construct
  misc_feature 1..472: note = Synthetic polypeptide
  source 1..472: mol_type = other DNA
atgtccctcctcagaaacaggctccaggccctgcctgccctgtgcctctgcgtgctggtcctggcctgcattggggcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcaggcccccagcccctcctccctctaacc

SEQ ID NO: 3327 - DNA, 241 bp, synthetic construct
  misc_feature 1..241: note = Synthetic polypeptide
  source 1..241: mol_type = other DNA
atgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcaggcccccagcccctcctccctctaacc

SEQ ID NO: 3328 - DNA, 1166 bp, synthetic construct
  misc_feature 1..1166: note = Synthetic polypeptide
  source 1..1166: mol_type = other DNA
atgccggggctgcgccgggaccgcctactgactctgctgctgctgggcgcgctgctctccgccgacctctacttccacctctggccccaagtacagcgccagctgcggcctcgggagcgcccgcgggggtgcccgtgcaccggccgcgcctcctccctggcgcgggactcggccgcagctgcctcggaccccggcacgatcgtgcacaacttttcccgaaccgagccccggactgaaccggctggcggcagccacagcgggtcgagctccaagttgcaggccctcttcgcccacccgctgtacaacgtcccggaggagccgcctctcctgggagccgaggactcgctcctggccagccaggaggcgctgcggtattaccggaggaaggtggcccgctggaacaggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagacagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggagacctagcaccctccctggcacatagcaggtactccacactagctgactgagtgaat

SEQ ID NO: 3329 - DNA, 1695 bp, synthetic construct
  misc_feature 1..1695: note = Synthetic polypeptide
  source 1..1695: mol_type = other DNA
atgggggccttggccagagccctgccgtccatactgctggcattgctgcttacgtccaccccagaggctctgggtgccaaccccggcttggtcgccaggatcaccgacaagggactgcagtatgcggcccaggaggggctattggctctgcagagtgagctgctcaggatcacgctgcctgacttcaccggggacttgaggatcccccacgtcggccgtgggcgctatgagttccacagcctgaacatccacagctgtgagctgcttcactctgcgctgaggcctgtccctggccagggcctgagtctcagcatctccgactcctccatccgggtccagggcaggtggaaggtgcgcaagtcattcttcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtggctgttgaacctcttccacaaccagattgagtccaagttccagaaagtactggagagcaggatttgcgaaatgatccagaaatcggtgtcctccgatctacagccttatctccaaactctgccagttacaacagagattgacagtttcgccgacattgattatagcttagtggaagcccctcgggcaacagcccagatgctggaggtgatgtttaagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatgataccgcctgactctaatatccgactgaccaccaagtccttccgacccttcgtcccacggttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggccactaatgtgtccgccaccttgaccttcaataccagcaagatcactgggttcctgaagccaggaaaggtaaaagtggaactgaaagaatccaaagttggactattcaatgcagagctgttggaagcgctcctcaactattacatccttaacaccttctaccccaagttcaatgataagttggccgaaggcttcccccttcctctgctgaagcgtgttcagctctacgaccttgggctgcagatccataaggccaggagcggtggttcatgcctgtaaccccagcactttgggaggccaaggcgggcagatcatgaggtcaaaagtttgagaccagcctggccaacatggtgaaaccccatctctactaaaaatacaaaaattagctgggcatggtggtgcgcacctgtaatcccagctactcaggaggctgaggcaggagaatggcttgaacacgggaggcagaggttgcagtgagctgagatcatgccactgcactccagcctgggcgacagagcaagactccatctcaaaagaaaaaaaaaa

SEQ ID NO: 3330 - DNA, 159 bp, synthetic construct
  misc_feature 1..159: note = Synthetic polypeptide
  source 1..159: mol_type = other DNA
atggcgctgtcctgggttcttacagtcctgagcctcctacctctgctggaagcccagatcccattgtgtgccaacctagtaccggtgcccatcaccaacgccaccctggaccggggagagatctgcctgagtctcctcccagctgacagtcaaagattc

SEQ ID NO: 3331 - DNA, 1111 bp, synthetic construct; identical to SEQ ID NO: 1156
  misc_feature 1..1111: note = Synthetic polypeptide
  source 1..1111: mol_type = other DNA

SEQ ID NO: 3332 - DNA, 1138 bp, synthetic construct; identical to SEQ ID NO: 1157
  misc_feature 1..1138: note = Synthetic polypeptide
  source 1..1138: mol_type = other DNA

SEQ ID NO: 3333 - DNA, 1345 bp, synthetic construct; identical to SEQ ID NO: 1158
  misc_feature 1..1345: note = Synthetic polypeptide
  source 1..1345: mol_type = other DNA

SEQ ID NO: 3334 - DNA, 1249 bp, synthetic construct; identical to SEQ ID NO: 1159
  misc_feature 1..1249: note = Synthetic polypeptide
  source 1..1249: mol_type = other DNA

SEQ ID NO: 3335 - DNA, 397 bp, synthetic construct
  misc_feature 1..397: note = Synthetic polypeptide
  source 1..397: mol_type = other DNA
atggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccacccacccccacagaggcctgaggagacctctgcccagggattccgccagctgctggagctgaacctactggggacgtacaccttgaccaaggcctgctcctgtctcagaaccttggcac

SEQ ID NO: 3336 - DNA, 289 bp, synthetic construct
  misc_feature 1..289: note = Synthetic polypeptide
  source 1..289: mol_type = other DNA
gttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccacccacccccacagaggcctgaggagacctctgcccagggattccgccagctgctggagctgaacctactggggacgtacaccttgaccaaggcctgctcctgtctcagaaccttggcac

SEQ ID NO: 3337 - DNA, 350 bp, synthetic construct
  misc_feature 1..350: note = Synthetic polypeptide
  source 1..350: mol_type = other DNA
atgatctccatcaccgaatggcagaatgcataacctgaagctagtcgtgaggaaacatccgacaaacccaaatggagggatggctacagaataagtggcctgaatcttcaaaagtgtcaaggtcatgccaaggaaagaccaaggagctgttccagacagaagagtttaaagagacatgatcattaaataccacacagaatgatgaactggattattttgctataaatgatgctactggagtaactgatgaaacttaaatggagtctgagggttggaggatagtcacatatcaatgttagtgtcccaattttgatggctgtatgttggctgtttaggagaattttttgttt

SEQ ID NO: 3338 - DNA, 1372 bp, synthetic construct; identical to SEQ ID NO: 1756
  misc_feature 1..1372: note = Synthetic polypeptide
  source 1..1372: mol_type = other DNA

SEQ ID NO: 3339 - DNA, 169 bp, synthetic construct
  misc_feature 1..169: note = Synthetic polypeptide
  source 1..169: mol_type = other DNA
atggcgatggatgtcacaaggagccaggcccagacagccttgactctgccagactctcctctgaactcgggcctcacatggccaactgctacttggaacaaatcgccccttggctggcagatgtgttaacatgcccagaccaagatcccaactcccacaacccaactcc

SEQ ID NO: 3340 - DNA, 1606 bp, synthetic construct; identical to SEQ ID NO: 327
  misc_feature 1..1606: note = Synthetic polypeptide
  source 1..1606: mol_type = other DNA

SEQ ID NO: 3341 - DNA, 175 bp, synthetic construct; identical to SEQ ID NO: 329
  misc_feature 1..175: note = Synthetic polypeptide
  source 1..175: mol_type = other DNA

SEQ ID NO: 3342 - DNA, 103 bp, synthetic construct; identical to SEQ ID NO: 173
  misc_feature 1..103: note = Synthetic polypeptide
  source 1..103: mol_type = other DNA

SEQ ID NO: 3343 - DNA, 775 bp, synthetic construct; identical to SEQ ID NO: 215
  misc_feature 1..775: note = Synthetic polypeptide
  source 1..775: mol_type = other DNA

SEQ ID NO: 3344 - DNA, 461 bp, synthetic construct
  misc_feature 1..461: note = Synthetic polypeptide
  source 1..461: mol_type = other DNA
atggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccaggtctttgttcttgcaccaccttcccagggacgctctccttgcagcgactgaaaagtgcaacctcaccccaccctccatgccggcactcccctccctcggtggcattttatttttctctgtggccccttcctatcttgtgacacataatatatcctacttatttgtccctttcttgatttgtctcacctactgagctttgagttccacaggggtcggggtttttgtctgatttgttcattgcagtggtgatttgttcactgcctaaaatagagcctggcaggtacaaagtgtttggtaaata

SEQ ID NO: 3345 - DNA, 1834 bp, synthetic construct; identical to SEQ ID NO: 133
  misc_feature 1..1834: note = Synthetic polypeptide
  source 1..1834: mol_type = other DNA

SEQ ID NO: 3346 - DNA, 1765 bp, synthetic construct; identical to SEQ ID NO: 135
  misc_feature 1..1765: note = Synthetic polypeptide
  source 1..1765: mol_type = other DNA

SEQ ID NO: 3347 - DNA, 312 bp, synthetic construct; identical to SEQ ID NO: 1728
  misc_feature 1..312: note = Synthetic polypeptide
  source 1..312: mol_type = other DNA

SEQ ID NO: 3348 - DNA, 980 bp, synthetic construct; identical to SEQ ID NO: 139
  misc_feature 1..980: note = Synthetic polypeptide
  source 1..980: mol_type = other DNA

SEQ ID NO: 3349 - DNA, 1256 bp, synthetic construct; identical to SEQ ID NO: 140
  misc_feature 1..1256: note = Synthetic polypeptide
  source 1..1256: mol_type = other DNA

SEQ ID NO: 3350 - DNA, 1277 bp, synthetic construct; identical to SEQ ID NO: 142
  misc_feature 1..1277: note = Synthetic polypeptide
  source 1..1277: mol_type = other DNA

SEQ ID NO: 3351 - DNA, 1358 bp, synthetic construct
  misc_feature 1..1358: note = Synthetic polypeptide
  source 1..1358: mol_type = other DNA
atgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcatttctcctttaggttctgcata

SEQ ID NO: 3352 - DNA, 1166 bp, synthetic construct
  misc_feature 1..1166: note = Synthetic polypeptide
  source 1..1166: mol_type = other DNA
atgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcatttctcctttaggttctgcata

SEQ ID NO: 3353 - DNA, 976 bp, synthetic construct
  misc_feature 1..976: note = Synthetic polypeptide
  source 1..976: mol_type = other DNA
atgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaagagatgacacccactctgacagggccgagggaagaaccataagcgatggcaatgcaacagagtggcacatgacaagagctcagcgaat

SEQ ID NO: 3354 - DNA, 857 bp, synthetic construct; identical to SEQ ID NO: 1374
  misc_feature 1..857: note = Synthetic polypeptide
  source 1..857: mol_type = other DNA

SEQ ID NO: 3355 - DNA, 836 bp, synthetic construct
  misc_feature 1..836: note = Synthetic polypeptide
  source 1..836: mol_type = other DNA
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3356 - DNA, 839 bp, synthetic construct
  misc_feature 1..839: note = Synthetic polypeptide
  source 1..839: mol_type = other DNA
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagcagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3357 - DNA, 938 bp, synthetic construct; identical to SEQ ID NO: 2101
  misc_feature 1..938: note = Synthetic polypeptide
  source 1..938: mol_type = other DNA

SEQ ID NO: 3358 - DNA, 2394 bp, synthetic construct
  misc_feature 1..2394: note = Synthetic polypeptide
  source 1..2394: mol_type = other DNA
atggacggtgccatggggcctcgggggctgctgttgtgcatgtacctggtatctctcctcatcctgcaggccatgcctgccctgggctcggctacaggcaggtccaagagcagcgagaagcgacaggctgtggacaccgctgtcgatggcgtgttcatccggagtttgaaagtcaactgcaaagtcacctctcgcttcgcccactatgttgtcaccagccaagtggtcaacactgccaatgaagccagggaagtggccttcgacctggaaatccccaagacagcattcatcagtgactttgccgttacagcagatggaaacgcatttatcggagacataaaggacaaggtgactgcatggaagcagtaccggaaagcagctatctcaggagagaatgccggccttgtcagggcctcggggagaactatggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcagtcgagacaagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacgggctcggagtgaggattgaatgatgcagtttgcacagagggcttagcacaggacctggcacattgcaagggccc

SEQ ID NO: 3359 - DNA, 1968 bp, synthetic construct
  misc_feature 1..1968: note = Synthetic polypeptide
  source 1..1968: mol_type = other DNA
atggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcagtcgagacaagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacgggctcggagtgaggattgaatgatgcagtttgcacagagggcttagcacaggacctggcacattgcaagggccc

SEQ ID NO: 3360 - DNA, 1530 bp, synthetic construct
  misc_feature 1..1530: note = Synthetic polypeptide
  source 1..1530: mol_type = other DNA
atgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacgggctcggagtgaggattgaatgatgcagtttgcacagagggcttagcacaggacctggcacattgcaagggccc

SEQ ID NO: 3361 - DNA, 1053 bp, synthetic construct
  misc_feature 1..1053: note = Synthetic polypeptide
  source 1..1053: mol_type = other DNA
tccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagagggtataggctgcagggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacgggctcggagtgaggattgaatgatgcagtttgcacagagggcttagcacaggacctggcacattgcaagggccc

SEQ ID NO: 3362 - DNA, 492 bp, synthetic construct
  misc_feature 1..492: note = Synthetic polypeptide
  source 1..492: mol_type = other DNA
atgccactccccctcccatcagcgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacgggctcggagtgaggattgaatgatgcagtttgcacagagggcttagcacaggacctggcacattgcaagggccc

SEQ ID NO: 3363 - DNA, 750 bp, synthetic construct
  misc_feature 1..750: note = Synthetic polypeptide
  source 1..750: mol_type = other DNA
atgccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaaggaaatgcttcatgggaaaccc

SEQ ID NO: 3364 - DNA, 732 bp, synthetic construct
  misc_feature 1..732: note = Synthetic polypeptide
  source 1..732: mol_type = other DNA
atgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaaggaaatgcttcatgggaaaccc

SEQ ID NO: 3365 - DNA, 1393 bp, synthetic construct
  misc_feature 1..1393: note = Synthetic polypeptide
  source 1..1393: mol_type = other DNA
atgatccagttgacagctacccctgtgagtgcacttgttgatgagccagtgcatatccgagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggcacagactgccaaggctgggggcaacatatctgtatcaaaagaggaagcttggaaaccggtaggaccttgacgccaggtggcctcaaatctccacttcctgcattctgctgcaatgctcctcacctgccccaggtatggttcacgcaggcccatgtgcagtttgggccactctctggaaggcaatatagtaaatcttggtggtgtctgtgcagtgctatctctaccaaagtgcagagtgcacaagtcatgagggcatgcctgcctccacttagatttcaaaggatgccccagaaagcctcagagcccagacagagaactatcacaggagcaggaccaccacagacagcccccaccccagtatggcaatgcccagtgaaaccgtgggagcagagccacccccaagaccccagactggtagagccaccagtgtgcaattccagcctgggagagccataggcatgtgactccaatatgtgagaaatgctatatgggttttgcccagcaaagtcatggccaggactaccccccaccccccaagtgtttagaaggtaaaatgtcaagtcgaagattattcttgagccttaatatttgccctgttgggttttacagttagtcaggatttattatctttttcttccttcctacttctaccttttggaaaggaaatgtctgccctgtgcctatcccaccattgtattttcaaagcatgtaacttgtttgatttcagaggctcacagctgaaggggaatttgcctcaggatgagtcacacctttgagtctcagtcatatttgatttaaatgagactttggacctcagacttttgaattggtgctggaacaagttaaggcctggggagctactgggatggaatgaatacattctgcatgtgagaagaacatacatttcggacggccagaagcagaa

SEQ ID NO: 3366 - DNA, 584 bp, synthetic construct
  misc_feature 1..584: note = Synthetic polypeptide
  source 1..584: mol_type = other DNA
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagggacatggatgaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3367 - DNA, 2161 bp, synthetic construct; identical to SEQ ID NO: 288
  misc_feature 1..2161: note = Synthetic polypeptide
  source 1..2161: mol_type = other DNA

SEQ ID NO: 3368 - DNA, 2140 bp, synthetic construct; identical to SEQ ID NO: 289
  misc_feature 1..2140: note = Synthetic polypeptide
  source 1..2140: mol_type = other DNA

SEQ ID NO: 3369 - DNA, 529 bp, synthetic construct; identical to SEQ ID NO: 287
  misc_feature 1..529: note = Synthetic polypeptide
  source 1..529: mol_type = other DNA

SEQ ID NO: 3370 - DNA, 1260 bp, synthetic construct
  misc_feature 1..1260: note = Synthetic polypeptide
  source 1..1260: mol_type = other DNA
atgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtggctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctctattacgtggcagagagttttaatgatgccaaggagaaagtaagcccctggaacaatacctgacacagagtaagcactcaataaataattggtgaaggcattaat

SEQ ID NO: 3371 - DNA, 1245 bp, synthetic construct
  misc_feature 1..1245: note = Synthetic polypeptide
  source 1..1245: mol_type = other DNA
atgtcagccctaaccccaaccttggttttctgtcacatgcatgtagaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtggctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctctattacgtggcagagagttttaatgatgccaaggagaaagtaagcccctggaacaatacctgacacagagtaagcactcaataaataattggtgaaggcattaat

SEQ ID NO: 3372 - DNA, 559 bp, synthetic construct; identical to SEQ ID NO: 1701
  misc_feature 1..559: note = Synthetic polypeptide
  source 1..559: mol_type = other DNA

SEQ ID NO: 3373 - DNA, 1638 bp, synthetic construct
  misc_feature 1..1638: note = Synthetic polypeptide
  source 1..1638: mol_type = other DNA
atggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagaaaaatactgaagaatgttcttcattcaaatgcctgaaaccttgttagagaaagtcctgagctccagcaatcaggaaacctcgtgtaggagaatgagagtgtcagggaggctgcctagcaccagacctagaaaacaactacttcagaacagacctgggggataattcagaagtgagatgagacagcaagaacaaaagagatgtgacagattttatgagagtttccaataactaaaaaggagtttcaaacatctgctggaacatttgtaaataattctaacttgggaaatggaaaattacaaattgaaataaagagacattgttaagcccaggaaagtacaaaaataaaatttaatcatagttgtcttaccagagaaccatatttgtgtagtcagaatgatgtaagcaatgaatactgatatcataaaaattgtcatctaaatatattctggaaaaagcagtgtggaaaagtgagtgtgtctatctgagggtgtgttcaaatatgaggggaagatggagattaaaattctcatctctcttaataaaaaattattaaatataatctacaaaaagataagtaagaattagaaacagagtatttaaaaatgtgaatgtatgttcagaagaagctgctagaatgttcaaaatggtagatttggaaagtgtgagaatgaagag

SEQ ID NO: 3374 - DNA, 128 bp, synthetic construct; identical to SEQ ID NO: 144
  misc_feature 1..128: note = Synthetic polypeptide
  source 1..128: mol_type = other DNA

SEQ ID NO: 3375 - DNA, 1014 bp, synthetic construct
  misc_feature 1..1014: note = Synthetic polypeptide
  source 1..1014: mol_type = other DNA
atgatccagttgacagctacccctgtgagtgcacttgttgatgagccagtgcatatccgagctacaggcctgattccctttcagatggcacagactgccaaggctgggggcaacatatctgtatcaaaagaggaagcttggaaaccggtaggaccttgacgccaggtggcctcaaatctccacttcctgcattctgctgcaatgctcctcacctgccccaggtatggttcacgcaggcccatgtgcagtttgggccactctctggaaggcaatatagtaaatcttggtggtgtctgtgcagtgctatctctaccaaagtgcagagtgcacaagtcatgagggcatgcctgcctccacttagatttcaaaggatgccccagaaagcctcagagcccagacagagaactatcacaggagcaggaccaccacagacagcccccaccccagtatggcaatgcccagtgaaaccgtgggagcagagccacccccaagaccccagactggtagagccaccagtgtgcaattccagcctgggagagccataggcatgtgactccaatatgtgagaaatgctatatgggttttgcccagcaaagtcatggccaggactaccccccaccccccaagtgtttagaaggtaaaatgtcaagtcgaagattattcttgagccttaatatttgccctgttgggttttacagttagtcaggatttattatctttttcttccttcctacttctaccttttggaaaggaaatgtctgccctgtgcctatcccaccattgtattttcaaagcatgtaacttgtttgatttcagaggctcacagctgaaggggaatttgcctcaggatgagtcacacctttgagtctcagtcatatttgatttaaatgagactttggacctcagacttttgaattggtgctggaacaagttaaggcctggggagctactgggatggaatgaatacattctgcatgtgagaagaacatacatttcggacggccagaagcagaa

SEQ ID NO: 3376 - DNA, 609 bp, synthetic construct; identical to SEQ ID NO: 249
  misc_feature 1..609: note = Synthetic polypeptide
  source 1..609: mol_type = other DNA

SEQ ID NO: 3377 - DNA, 738 bp, synthetic construct; identical to SEQ ID NO: 250
  misc_feature 1..738: note = Synthetic polypeptide
  source 1..738: mol_type = other DNA

SEQ ID NO: 3378 - DNA, 537 bp, synthetic construct; identical to SEQ ID NO: 251
  misc_feature 1..537: note = Synthetic polypeptide
  source 1..537: mol_type = other DNA

SEQ ID NO: 3379 - DNA, 684 bp, synthetic construct; identical to SEQ ID NO: 253
  misc_feature 1..684: note = Synthetic polypeptide
  source 1..684: mol_type = other DNA

SEQ ID NO: 3380 - DNA, 285 bp, synthetic construct; identical to SEQ ID NO: 255
  misc_feature 1..285: note = Synthetic polypeptide
  source 1..285: mol_type = other DNA

SEQ ID NO: 3381 - DNA, 552 bp, synthetic construct; identical to SEQ ID NO: 254
  misc_feature 1..552: note = Synthetic polypeptide
  source 1..552: mol_type = other DNA

SEQ ID NO: 3382 - DNA, 1094 bp, synthetic construct; identical to SEQ ID NO: 153
  misc_feature 1..1094: note = Synthetic polypeptide
  source 1..1094: mol_type = other DNA

SEQ ID NO: 3383 - DNA, 451 bp, synthetic construct; identical to SEQ ID NO: 339
  misc_feature 1..451: note = Synthetic polypeptide
  source 1..451: mol_type = other DNA

SEQ ID NO: 3384 - DNA, 2217 bp, synthetic construct
  misc_feature 1..2217: note = Synthetic polypeptide
  source 1..2217: mol_type = other DNA
atggaccaaaatcaacatttgaataaaacagcagaggcacaaccttcagagaataagaaaacaagatactgcaatggattgaagatgttcttggcagctctgtcactcagctttattgctaagacactaggtgcaattattatgaaaagttccatcattcatatagaacggagatttgagatatcctcttctcttgttggttttattgacggaagctttgaaattggaaatttgcttgtgattgtatttgtgagttactttggatccaaactacatagaccaaagttaattggaatcggttgtttcattatgggaattggaggtgttttgactgctttgccacatttcttcatgggatattacaggtattctaaagaaactaatatcaattcatcagaaaattcaacatcgaccttatccacttgtttaattaatcaaattttatcactcaatagagcatcacctgagatagtgggaaaaggttgtttaaaggaatctgggtcatacatgtggatatatgtgttcatgggtaatatgcttcgtggaataggggagactcccatagtaccattggggctttcttacattgatgatttcgctaaagaaggacattcttctttgtatttaggtatattgaatgcaatagcaatgattggtccaatcattggctttaccctgggatctctgttttctaaaatgtacgtggatattggatatgtagatctaagcactatcaggataactcctactgattctcgatgggttggagcttggtggcttaatttccttgtgtctggactattctccattatttcttccataccattctttttcttgccccaaactccaaataaaccacaaaaagaaagaaaagcttcactgtctttgcatgtgctggaaacaaatgatgaaaaggatcaaacagctaatttgaccaatcaaggaaaaaatattaccaaaaatgtgactggttttttccagtcttttaaaagcatccttactaatcccctgtatgttatgtttgtgcttttgacgttgttacaagtaagcagctatattggtgcttttacttatgtcttcaaatacgtagagcaacagtatggtcagccttcatctaaggctaacatcttattgggagtcataaccatacctatttttgcaagtggaatgtttttaggaggatatatcattaaaaaattcaaactgaacaccgttggaattgccaaattctcatgttttactgctgtgatgtcattgtccttttacctattatattttttcatactctgtgaaaacaaatcagttgccggactaaccatgacctatgatggaaataatccagtgacatctcatagagatgtaccactttcttattgcaactcagactgcaattgtgatgaaagtcaatgggaaccagtctgtggaaacaatggaataacttacatctcaccctgtctagcaggttgcaaatcttcaagtggcaataaaaagcctatagtgttttacaactgcagttgtttggaagtaactggtctccagaacagaaattactcagcccatttgggtgaatgcccaagagatgatgcttgtacaaggaaattttacttttttgttgcaatacaagtcttgaatttatttttctctgcacttggaggcacctcacatgtcatgctgattgttaaaattgttcaacctgaattgaaatcacttgcactgggtttccactcaatggttatacgagcactaggaggaattctagctccaatatattttggggctctgattgatacaacgtgtataaagtggtccaccaacaactgtggcacacgtgggtcatgtaggacatataattccacatcattttcctcagattccagttcagaaatgagcattctcttcaccatcgcacactcagcaaaatctgattcccctgaaaccttctcatgcagtggctgtttactttttcttgctgctctgtgaatataggtaagtctcttctccttgttttagtttccaggccattctcctcacttcctcccaccacaaaggaagtggctccaaatttcatgtcatcagatcttaatacgatatctcactgctgcagtcatacctacatcaaagttaaactccccctttccaatgattttagttcctctctcttgtttcaaagccagtcttggtttgaaccttggttattttttatatgcccagagttga

SEQ ID NO: 3385 - DNA, 877 bp, synthetic construct; identical to SEQ ID NO: 970
  misc_feature 1..877: note = Synthetic polypeptide
  source 1..877: mol_type = other DNA

SEQ ID NO: 3386 - DNA, 763 bp, synthetic construct
  misc_feature 1..763: note = Synthetic polypeptide
  source 1..763: mol_type = other DNA
ggcctttcaggacctcctagatcaagttggaggcctggggagattccagatccttcagatggttttccttataatgttcaacgtcatagtataccatcaaactcagctggagaacttcgcagcattcatacttgatcatcgctgctgggttcatatactggacaatgacactatccctgacaatgaccctgggaccctcagccaggatgccctcctgagaatctccatcccattcgactcaaatctgaggccagagaagtgtcgtcgctttgtccatccccagtggaagctcattcatctgaatgggaccttccccaacacgagtgagccagatacagagccctgtgtggatggctgggtatatgaccaaagctccttcccttccaccattgtgactaagtgggatctggtatgcgaatctcaaccactgaattcagtagctaaatttctattcatggctggaatgatggtgggaggcaacctatatggccatttgtcagacaggaaaccattatcatcgcccaaccatgtctccactgattgtgacgagggacttgaggtgcccattgccatccaccagcatcacgtcttctgaaaaaggaatgaagaacttactctgtaccataacatggatgaataccaaaatcattttgtttgccacaagaacaaccaaaaatgattgcacacgataccacttcacttatgtaaacgtcaaagaaaagcaacgatggtgttgggagtcagaaaggtgattctctttagg

SEQ ID NO: 3387 - DNA, 2166 bp, synthetic construct
  misc_feature 1..2166: note = Synthetic polypeptide
  source 1..2166: mol_type = other DNA
atggagccgggcaggacccagataaagcttgaccccaggtacacagcagatcttctggaggtgctgaagaccaattacggcatcccctccgcctgcttctctcagcctcccacagcagcccaactcctgagagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtggtgtctgtgctgtgctgctttggtctctggatccctcgttccctggtgctggtggaaatgaccatcacctcgttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggaagaagcttcagctgctgatgttgggccctttccaatacgccttcttgaagataacgctgaccctggtgggcctgtttctcgtccccgacggcatctatgacccagcagacatttctgaggggagcacagctctatggatcaacactttccttggcgtgtccacactgctggctctctggaccctgggcatcatttcccgtcaagccaggctacacctgggtgagcagaacatgggagccaaatttgctctgttccagggttttgctgtgttggccgggctggtctccagctcctaaccgcgagtgatccgccagcctcggcctcccgaggtgccgggattgcagacggagtctcgttcactcagtgctcaatgctgcccaggctggagtgcagtggcgtgatctcggctcgctacaacctccacctcccagccgcctgccttggcctcccaaagtgctgagactgcagcctctgcccggccgccaccccgtctgggaagtgaggagcgtctctgcctggccgcccatcgtctgggatgtgaggagcccctctgcccggccgcccagtctgggaagtgaggagcgcctcttcccggccgcccatcgtctgagatgtggggagcgcctctgccccgccgccccatctgggatgtgaggagcgcctctgccaggccacgaccccgtctgggaactgaggagtgtctctgcccgaccgccacccagtcttggaggtgaggagcgcctctgcccggccacgaccccgtctgggatgtgaggagcgtctctgcctggccgcccatcgtctgggatgtgaggagcccctctgcccggctgcccagtctgggaagtgaggagcgcctcctccccgccgccatcccgtctaggaagtgaggagcgtctctgcccggccgcccatcgtctgagatgtggggagcgccactgccccgccgccccgtttgggatgtgaggagctcctctgcccggccgcgacccggtctgggaagtgaggagcgtctccgcccggcagccaccccgtccgggaggtgaggggcgcctctgcccggccgcccctactgggaggtgaggagcccctctgcccggccaccaccccgtctgggaggtgtacccaacagctcattgagaacgggccatgatgacgatggcggttttgtcgaatagaaaagggggaaatgtggggaaaagatagaaaaatcagattgttgctgtgtctgtgtagaaagaagtagacatgggagactcaattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcagggccctctgcctaggaaaaccagagacctttgttcacttgtttatctgctgaccttccgtccactattgtcctatgaccctgccaaatccccctctgcgagaaacacccaagaatgatcaataaaaatacataaataaataaaagaa

SEQ ID NO: 3388 - DNA, 1443 bp, synthetic construct
  misc_feature 1..1443: note = Synthetic polypeptide
  source 1..1443: mol_type = other DNA
caagccaggctacacctgggtgagcagaacatgggagccaaatttgctctgttccagggttttgctgtgttggccgggctggtctccagctcctaaccgcgagtgatccgccagcctcggcctcccgaggtgccgggattgcagacggagtctcgttcactcagtgctcaatgctgcccaggctggagtgcagtggcgtgatctcggctcgctacaacctccacctcccagccgcctgccttggcctcccaaagtgctgagactgcagcctctgcccggccgccaccccgtctgggaagtgaggagcgtctctgcctggccgcccatcgtctgggatgtgaggagcccctctgcccggccgcccagtctgggaagtgaggagcgcctcttcccggccgcccatcgtctgagatgtggggagcgcctctgccccgccgccccatctgggatgtgaggagcgcctctgccaggccacgaccccgtctgggaactgaggagtgtctctgcccgaccgccacccagtcttggaggtgaggagcgcctctgcccggccacgaccccgtctgggatgtgaggagcgtctctgcctggccgcccatcgtctgggatgtgaggagcccctctgcccggctgcccagtctgggaagtgaggagcgcctcctccccgccgccatcccgtctaggaagtgaggagcgtctctgcccggccgcccatcgtctgagatgtggggagcgccactgccccgccgccccgtttgggatgtgaggagctcctctgcccggccgcgacccggtctgggaagtgaggagcgtctccgcccggcagccaccccgtccgggaggtgaggggcgcctctgcccggccgcccctactgggaggtgaggagcccctctgcccggccaccaccccgtctgggaggtgtacccaacagctcattgagaacgggccatgatgacgatggcggttttgtcgaatagaaaagggggaaatgtggggaaaagatagaaaaatcagattgttgctgtgtctgtgtagaaagaagtagacatgggagactcaattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcagggccctctgcctaggaaaaccagagacctttgttcacttgtttatctgctgaccttccgtccactattgtcctatgaccctgccaaatccccctctgcgagaaacacccaagaatgatcaataaaaatacataaataaataaaagaa

SEQ ID NO: 3389 - DNA, 770 bp, synthetic construct
  misc_feature 1..770: note = Synthetic polypeptide
  source 1..770: mol_type = other DNA
atggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaaggaggccaccggaagatgtgtaccaccaaaacgaagaatataccaaaaaagataaaaagttgggattgagaaaatgtgagatccaacacatgaataatataaagatattccaaggtgaagatgaaagaagattgagaagacttggtagcagtagttctcaatgaagcaggactacagcagttctttaagaaggatgactctgaaaaaattagcagtgatagattgtaatgtttttgagaaagatatttcatactttttgagaattttagaaaggattagtgataagtaaacagaaaactgcacaaataaaagtgacataatt

SEQ ID NO: 3390 - DNA, 1041 bp, synthetic construct; identical to SEQ ID NO: 969
  misc_feature 1..1041: note = Synthetic polypeptide
  source 1..1041: mol_type = other DNA

SEQ ID NO: 3391 - DNA, 1339 bp, synthetic construct
  misc_feature 1..1339: note = Synthetic polypeptide
  source 1..1339: mol_type = other DNA
atggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaaaaaagtttgccagctcctg

SEQ ID NO: 3392 - DNA, 1603 bp, synthetic construct
  misc_feature 1..1603: note = Synthetic polypeptide
  source 1..1603: mol_type = other DNA
atggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaaaaaagtttgccagctcctg

SEQ ID NO: 3393 - DNA, 1519 bp, synthetic construct
  misc_feature 1..1519: note = Synthetic polypeptide
  source 1..1519: mol_type = other DNA
atggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaagggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaaaaaagtttgccagctcctg

SEQ ID NO: 3394 - DNA, 1642 bp, synthetic construct
  misc_feature 1..1642: note = Synthetic polypeptide
  source 1..1642: mol_type = other DNA
atggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgaggtaaatcagggatttcttcttgatttggatccattgttgcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaaaaaagtttgccagctcctg

SEQ ID NO: 3395 - DNA, 916 bp, synthetic construct; identical to SEQ ID NO: 1226
  misc_feature 1..916: note = Synthetic polypeptide
  source 1..916: mol_type = other DNA

SEQ ID NO: 3396 - DNA, 491 bp, synthetic construct
  misc_feature 1..491: note = Synthetic polypeptide
  source 1..491: mol_type = other DNA
atgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttgggattatgagagcgcctccttcagaggtcgctaggaggcttctgcgtgaagacggacagcaatggctgaggtgcggaaagtgctcgat

SEQ ID NO: 3397 - DNA, 518 bp, synthetic construct
  misc_feature 1..518: note = Synthetic polypeptide
  source 1..518: mol_type = other DNA
atgttgttactcttccactccaaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttgggattatgagagcgcctccttcagaggtcgctaggaggcttctgcgtgaagacggacagcaatggctgaggtgcggaaagtgctcgat

SEQ ID NO: 3398 - DNA, 1629 bp, synthetic construct; identical to SEQ ID NO: 2518
  misc_feature 1..1629: note = Synthetic polypeptide
  source 1..1629: mol_type = other DNA

SEQ ID NO: 3399 - DNA, 256 bp, synthetic construct
  misc_feature 1..256: note = Synthetic polypeptide
  source 1..256: mol_type = other DNA
atgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggtttgccgtgagattgaaatgagagagcgttcgaaccgtttggcacagcacctgcacgtaaagatgcttgatcaatg

SEQ ID NO: 3400 - DNA, 310 bp, synthetic construct
  misc_feature 1..310: note = Synthetic polypeptide
  source 1..310: mol_type = other DNA
atggggacctggggtgcccctcacaggacacttccttgcaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggtttgccgtgagattgaaatgagagagcgttcgaaccgtttggcacagcacctgcacgtaaagatgcttgatcaatg

SEQ ID NO: 3401 - DNA, 203 bp, synthetic construct
  misc_feature 1..203: note = Synthetic polypeptide
  source 1..203: mol_type = other DNA
atgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacaaaaagtttgccgactcccg

SEQ ID NO: 3402 - DNA, 1675 bp, synthetic construct
  misc_feature 1..1675: note = Synthetic polypeptide
  source 1..1675: mol_type = other DNA
atgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggtttggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaagtaaatcatcatcataggagtgtggaagctgctggtacaaaat

SEQ ID NO: 3403 - DNA, 244 bp, synthetic construct
  misc_feature 1..244: note = Synthetic polypeptide
  source 1..244: mol_type = other DNA
atgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaagtaaatcatcatcataggagtgtggaagctgctggtacaaaat

SEQ ID NO: 3404 - DNA, 1477 bp, synthetic construct
  misc_feature 1..1477: note = Synthetic polypeptide
  source 1..1477: mol_type = other DNA
atgcttcctgctgtggctgtctcggaacccgtggtcctccgcttcattctgccgagttcctgggattgcaggtgcgcgccgccactcctgactggtttttgtattttttggtggagacggggtttcaccgtgttggccgggctggtctccagctcctgaccgcgagtgatctgccagcctcggcgtcctgaggtgccgggattgcagacggagtctcgctcactcagtgctcaatgttgcccatgctggagtgcagtggcgtgatcttggctcgctacaacctccacctcccagccgcctgccttggcctcccaaagtgccgagattgcagcctctgcccggccgccaccccgtctaggaagtgaggagcgtctttgcctggccgcccatcgtcggggatgtgaggagcccctctgcccggccgcccagtctgggaagtgaggagcacctcttcccggccgtcatcctgtctaggaagtgaggagcgtctctgcccagccgcccatcatctgggatgtggggagcatctctgccccgtcgccccgtctgagatgtgaagagcgcctctgcccggccgcgaccctgtctgggaactgaggagtgtctctgccccgccgccaccccgtctgggaggtgaggagcgtctctgaccggctgcccggtctgagaagtgaggagcccctccgcccggcagccgccccgtctgggaagtgaggagcgtttccgctttccgcccggcagcggccccgtccgggaggtggggggcagcccccgcccggccggcgccccgtctgggaggtggagggcgcctctgcccggccgccccatctgggaagtgaggagcccctctgcccggccgccaccccgtctgggaggtgtacccaacagctcattgagaacgggccatgatgacgatggcagttttgtcgaatagaaaagggggaaatgtggggaaaagaaagagagatcagattgttactgtgtctgtgtggaaagaagtagacataggagactccattttgttctgtactaagaaaaattcttctgccttgggatgctgttaatctataaccttacccccaaccccgtgctctctgaaacatgtgctgtgtccactaagggttaaatggcccctgctctctgaaacatgtgctgtgtccgctaagggttaaatggcccgtgctctctgaaacgtgctgtgtccactaagggttaaatggattaagggcggtgcaagatgtgctttgttaaacagatgcttgaaggcagcatgctccttaagagttatcaccactccctaatctcaagtacccagggacaaacactgcagaaggcggcagggccctctgcctaggaaaaccagagacctttgttcatatgtttatctgctgaccttccctccactattgtcctatgaccctcccaaatccccctctccaagaaacacccaagaatgatcaataaatactaaaaaaaa

SEQ ID NO: 3405 - DNA, 687 bp, synthetic construct
  misc_feature 1..687: note = Synthetic polypeptide
  source 1..687: mol_type = other DNA
atgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagtg

SEQ ID NO: 3406 - DNA, 360 bp, synthetic construct
  misc_feature 1..360: note = Synthetic polypeptide
  source 1..360: mol_type = other DNA
cacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagtg

SEQ ID NO: 3407 - DNA, 811 bp, synthetic construct
  misc_feature 1..811: note = Synthetic polypeptide
  source 1..811: mol_type = other DNA
atgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgaggctaggtgcagtggctcacacttgtaatcccagctgtttgggaggccaaggcgggaggatcgcttgagcccaagagtccaagaccagcctgggcaacacagccagaccctgtctctacaaaaaagaaaagttaaaaacaaacaaaaaaacagctgtgtgtggtggtgcttgcttgtggttgcagctaccccaggaggctgaggcaggaggatcacttgagcccaggaattccaggctgcagtgagccgtgatcgcaccactgcactccagcctgggtggcagagtgagaccctgtctcaaaaaataa

SEQ ID NO: 3408 - DNA, 691 bp, synthetic construct
  misc_feature 1..691: note = Synthetic polypeptide
  source 1..691: mol_type = other DNA
atgacgacttacagtgacaaaggggcaaagcctgagagaggccgattcctccacttccactctgtgaccttctgggttggcaacgccaagcaggccacgtcattctactgcagcaagatgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgcactttgtgaggccgaggcaggtggatcacctgagttcaggagttcgagaccagcctggccaacgtggcaaaaccctgtctttactaaatatacaaaaattagctgggcatgacaggcgcctgtaatcccagctactcgggaggctgaggcagaagaatcacttgaacccgggagacagaggttgcagtgagccaaggttgcaccactgtactccagcctgggcgacagagcgagactccatctcaaataaataaataaaaattttaaaaaataaaa

SEQ ID NO: 3409 - DNA, 574 bp, synthetic construct
  misc_feature 1..574: note = Synthetic polypeptide
  source 1..574: mol_type = other DNA
atgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgcactttgtgaggccgaggcaggtggatcacctgagttcaggagttcgagaccagcctggccaacgtggcaaaaccctgtctttactaaatatacaaaaattagctgggcatgacaggcgcctgtaatcccagctactcgggaggctgaggcagaagaatcacttgaacccgggagacagaggttgcagtgagccaaggttgcaccactgtactccagcctgggcgacagagcgagactccatctcaaataaataaataaaaattttaaaaaataaaa

SEQ ID NO: 3410 - DNA, 115 bp, synthetic construct
  misc_feature 1..115: note = Synthetic polypeptide
  source 1..115: mol_type = other DNA
atgaggctcttcctgtcgctcccggtcctggtggtggttctgtcgatcgtcttggaaggcggaggttgcagtaagccgagatcgcaccatttgacacagcaagtctccgtctcaa

SEQ ID NO: 3411 - DNA, 197 bp, synthetic construct
  misc_feature 1..197: note = Synthetic polypeptide
  source 1..197: mol_type = other DNA
atggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatgctccaaccaagtacagtgaaactggaat

SEQ ID NO: 3412 - DNA, 148 bp, synthetic construct
  misc_feature 1..148: note = Synthetic polypeptide
  source 1..148: mol_type = other DNA
atgctgcctaagagaagcaggccgagcacggtggctcacacctctaatcccagcactttggaaggctgagacaagaggattgttgaggtcaggaattcaagaccagcctggtcaacagagtgagatgtcctctctaggaaaagaagaa

SEQ ID NO: 3413 - DNA, 496 bp, synthetic construct
  misc_feature 1..496: note = Synthetic polypeptide
  source 1..496: mol_type = other DNA
atggcggcccccgggagctgtgctctatggagctattgcggccgtgggtggtcgcgggcgatgcggggctgccagctcctcgggcttcgtagctcttggcccggggacctactaagtgctcggctcttgtcccaagagaagcgggcagcggaaacgcactttgggtttgagactgtgtcggaagaggagaaggggggcaaagccaggtgcgatggttcacacctgtaatcccagcactttgggaggccgaggtaggcacttgaagtcaggagttcgagaccagcctggccaacgtggtgaaacctcatctctactaaaaatacaaaaaaaattagccaagcatggtgacgcacgcctgtaatcacagctaattaggaggctgaggcaggcaaatttcttgaacctgggaggtggacgttgcagtgatctgagattgtgccactgcactctagcctgggcgacacagtgagactgtctcaaaaacaaagaaaaaaaa

SEQ ID NO: 3414 - DNA, 312 bp, synthetic construct; identical to SEQ ID NO: 2525
  misc_feature 1..312: note = Synthetic polypeptide
  source 1..312: mol_type = other DNA

SEQ ID NO: 3415 - DNA, 998 bp, synthetic construct
  misc_feature 1..998: note = Synthetic polypeptide
  source 1..998: mol_type = other DNA
atgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatgctgtatgaccttgattgtgtgccttaaccgctctgtgacacagtctacctgtctgcaaaatgggaaacataatacctgccatcaggattgttgaggagtaaataa

SEQ ID NO: 3416 - DNA, 833 bp, synthetic construct
  misc_feature 1..833: note = Synthetic polypeptide
  source 1..833: mol_type = other DNA
atgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatgctgtatgaccttgattgtgtgccttaaccgctctgtgacacagtctacctgtctgcaaaatgggaaacataatacctgccatcaggattgttgaggagtaaataa

SEQ ID NO: 3417 - DNA, 2227 bp, synthetic construct
  misc_feature 1..2227: note = Synthetic polypeptide
  source 1..2227: mol_type = other DNA
cagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaagagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtgggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccg

SEQ ID NO: 3418 - DNA, 2740 bp, synthetic construct
  misc_feature 1..2740: note = Synthetic polypeptide
  source 1..2740: mol_type = other DNA
atgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctcccccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtgggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccg

SEQ ID NO: 3419 - DNA, 2701 bp, synthetic construct
  misc_feature 1..2701: note = Synthetic polypeptide
  source 1..2701: mol_type = other DNA
atgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctcccccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtgggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccg

SEQ ID NO: 3420 - DNA, 1352 bp, synthetic construct; identical to SEQ ID NO: 1101
  misc_feature 1..1352: note = Synthetic polypeptide
  source 1..1352: mol_type = other DNA

SEQ ID NO: 3421 - DNA, 1589 bp, synthetic construct; identical to SEQ ID NO: 1102
  misc_feature 1..1589: note = Synthetic polypeptide
  source 1..1589: mol_type = other DNA

SEQ ID NO: 3422 - DNA, 506 bp, synthetic construct; identical to SEQ ID NO: 1096
  misc_feature 1..506: note = Synthetic polypeptide
  source 1..506: mol_type = other DNA

SEQ ID NO: 3423 - DNA, 1335 bp, synthetic construct
  misc_feature 1..1335: note = Synthetic polypeptide
  source 1..1335: mol_type = other DNA
atggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaagaacttctgttcaca

SEQ ID NO: 3424 - DNA, 1599 bp, synthetic construct
  misc_feature 1..1599: note = Synthetic polypeptide
  source 1..1599: mol_type = other DNA
atggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaagaacttctgttcaca

SEQ ID NO: 3425 - DNA, 1515 bp, synthetic construct
  misc_feature 1..1515: note = Synthetic polypeptide
  source 1..1515: mol_type = other DNA
atggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaagggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaagaacttctgttcaca

SEQ ID NO: 3426 - DNA, 1638 bp, synthetic construct
  misc_feature 1..1638: note = Synthetic polypeptide
  source 1..1638: mol_type = other DNA
atggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgaggtaaatcagggatttcttcttgatttggatccattgttgcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaaagaacttctgttcaca

SEQ ID NO: 3427 - DNA, 297 bp, synthetic construct
  misc_feature 1..297: note = Synthetic polypeptide
  source 1..297: mol_type = other DNA
atgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgcactatgggaggctgagatgggaggattgcttgagcccaggagttcgagaccagcctgaccaacatggcgagatcctgtctccatttaaaaaaaaaaaaaaaa

SEQ ID NO: 3428 - DNA, 2797 bp, synthetic construct
  misc_feature 1..2797: note = Synthetic polypeptide
  source 1..2797: mol_type = other DNA
atgtttcagactaagctacgaaatgaaacttgggaagacttgccaaaaatgtcctgcacaactgagatccaagcagcattcattctctcttcctttgtgaccttcttcagtggactcatcatcctgttgatcttcaggctgatctggagatctgttaaaaaatggcaaatcatcaagggaacaggaattatcttggaactgttcacatcaggtaccatcgctaggagccatgtaagaagcctccacttccagggacaatttcgtgatcatatagaaatgttgctttcagcccagacctttgtggggcaagtgttggtgatccttgtctttgtactaagcattgggtctcttataatctatttcatcaattctgctgaccctgttggaagctgttcatcatatgaagacaaaaccattcctattgatttggttttcaatgctttctttagtttctattttggattgaggtttatggcagctgatgacaagatcaagttctggctggagatgaattcaatcgtagacatctttaccatcccaccaacctttatttcttattatttgaagagcaattggctaggtttaaggttcctaagagccttgcgcctgctagaactccctcaaatcttgcaaattctacgagccatcaagaccagtaactcagtgaagttttccaaactgctgtcaataattctcagtacctggttcacagctgcgggattcattcacctggtggaaaattctggtgatccctggctcaaaggtagaaattcacagaatatatcatattttgagtcaatttacctggtcatggcaacaacgtcaaccgttggatttggagatgtggtagccaagacatccttaggacggaccttcatcatgttcttcacactggggagtttgatattatttgcgaactatatacctgaaatggtggaactgtttgctaacaagaggaaatacaccagttcctatgaagcactcaaaggaaagaagtttattgtggtctgtggaaacatcactgtggacagtgtgaccgctttcctgaggaatttcctccgcgacaagtcaggagagatcaacactgaaattgttttcctgggagaaacccctccttctttggaacttgaaaccatatttaaatgctacttggcctacacaacgttcatttctggatctgcaatgaagtgggaggatctgaggcgagttgcggtggaatctgcagaggcatgcctgattatagccaatcctttgtgcagtgattcccatgctgaagatatttccaacattatgagggtgctctctatcaagaactatgattctaccaccagaatcatcatacagatactgcaatcccataacaaggtttatctgccaaagattcccagctggaactgggacaccggagacaacatcatctgctttgctgaattaaaacttggatttatcgcccaaggctgtttggtgccaggcttgtgtaccttcctaacatctctatttgtggagcaaaacaaaaaggttatgcctaaacagacctggaagaaacacttcttgaatagcatgaaaaacaaaattctgacccaacgtctctctgatgactttgctggaatgagctttcctgaagttgcccggctctgctttctgaagatgcacctcctgttgatagccatcgaatacaagtccctctttacggatggtttctgtggtctgatactaaatccacctccacaagtgaggatacgtaagaacacattagggttctttattgctgaaactccaaaggacgtcagaagagccttgttttactgttcagtctgtcatgatgatgtgttcattcctgagctaattacaaactgtggctgcaaaagcagaagccggcagcacatcacagtgccatcggtaaagagaatgaaaaaatgtctgaagggaatctcctctcgtatatcagggcaggattctccgccaagggtatctgcaagcacttcgagcatatcaaacttcaccaccaggactcttcaacatgatgtagaacaagattctgaccagcttgatagcagtgggatgtttcactggtgcaaaccaacctctttggacaaggtgactctgaaacgaactggcaagtcaaagtataagtttcggaaccatattgtagcatgtgtatttggagatgcccactcagccccgatggggcttcggaactttgtaatgcccttgagagccagcaactataccaggaaggagctgaaggacatagtgttcattgggtctctggactatctacagagagaatggcgatttctctggaattttccccagatatacattctgcctggatgtgcactttattctggagacctccatgcggccaacatagagcaatgctccatgtgtgctgtcttgtcccccccaccccagccatcaagcaaccagactttggtagacacagaagccatcatggcaaccctcaccatcggatccttgcaaattgactcctcctctgacccgtcaccctcagtgtcagaggagactccaggttacacaaatggacataatgagaaatcaaactgccgaaaagtccctatccttactgaactgaaaaatccttccaacattcactttattgaacagcttggtggactggaagggtccctccaagaaacaaatctgcatctcagcactgccttttctacgggcactgttttttccggcagcttcttggattctctgctggccacggagatctgggatcccagaaatctacactcattaatatcacttcagatgatccagatacatg

SEQ ID NO: 3429 - DNA, 277 bp, synthetic construct; identical to SEQ ID NO: 1903
  misc_feature 1..277: note = Synthetic polypeptide
  source 1..277: mol_type = other DNA

SEQ ID NO: 3430 - DNA, 1162 bp, synthetic construct
  misc_feature 1..1162: note = Synthetic polypeptide
  source 1..1162: mol_type = other DNA
atgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaata

SEQ ID NO: 3431 - DNA, 865 bp, synthetic construct
  misc_feature 1..865: note = Synthetic polypeptide
  source 1..865: mol_type = other DNA
atgccacagtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaata

SEQ ID NO: 3432 - DNA, 1889 bp, synthetic construct
  misc_feature 1..1889: note = Synthetic polypeptide
  source 1..1889: mol_type = other DNA
atgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaaatggagtcccactctgttgcccaggctggagtacagtggcatgatcttggctcactgcaacctccacctcccagatgtcaagcgattctcttgcctcagcctcccaagtagctggggttacaggcatgtgccaccatgctgagaaacctgaacggactccatttggctccttcatttgcaagacatcaagggctccttacccacccccttcctcaaggaattaacttgtgcaagctgactcccagcacatcaaagaatgcaattaactgataacatgctgtggcaagctatgtccgcagttcccaggaatttgtccagttgatattaccctaagcccctgtgtttttgtctggttgatagcacccaaagcccagcgtctatcaccttgtgatggatttaaagcccctgcacctggaactgtttgctttcctgtaaccatttgtctttttaacttcttttgcctgttttacttctgtaagactgctacagctaggctccccctcccctctctaaaccaaagtataaaacaaaatctagccccttcttcagggccgagagaattttgagcactagccgtctctcggtcgctggctaataaaggactcctcaattcgtctcagagtgtggcgtttctgtataactcgctcggttacaaca

SEQ ID NO: 3433 - DNA, 1357 bp, synthetic construct
  misc_feature 1..1357: note = Synthetic polypeptide
  source 1..1357: mol_type = other DNA
atgggccgaggggtgcgcgtgctgctgctgctgagcctgctgcactgcgccgggggcagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagctgggcgtggtggcgggtgcctgtaatccagctactccggaggctgaggcaggagaatcgcttgaacctgggagacagaggttatggtgagtcgagattgcaacattgcactccatcctgggggcaacaagagtgaaactccatctcaaaaaaaaaagaaaaaaaaaaaaaga

SEQ ID NO: 3434 - DNA, 1222 bp, synthetic construct
  misc_feature 1..1222: note = Synthetic polypeptide
  source 1..1222: mol_type = other DNA
atgtgtgtgggagagaagcgaagggcaatcattccttctcacttggcctatggaaaacggggatttccaccatctgtcccagccgcctgccttggcctcccgaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcctggccgccatcccatctgggaagtgaggagcgcctcttcccggccgccatcacatctaggaagtgaggagcgtctctgcccggccgcccatcgtctgggatgtggggagtgcctctgccccgccgccctgtctgggatgtgaggagcgcctctgcccggccgccaccccgtctgggaggtgaggagcgtctctgcccagccgccccgtctgagaagtgaggagaccctccgcccggcagctgccccgtctgagaagtgaggagcctctccgcccggcagccaccccgtccgggagggaggtgggggggtcagccccccgcccggccagccgccccatccgggaggtgaggggtgcctctgcccggccgcccctactgggaagtgaggagcccctctgcccggccgcccctactgggaagtgaggagcccctctgcccggccaccaccccgtctgggaggtgtgcccaacagctcattgagaacgggccaggatgacaatggcggctttgcggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagagttaagtggattaagggcggtgcaagatgtgctttgttaaacagatgcttgaaggcagcatgctcattaagagtcatcaccactccctaatctcaagtacccagggacacaaacgctgtggaaggccgcagggtcctctgcctaggaaaaccagagacctttgttcacttgtttatctgctgaccttccctccactattgtcctgtgaccctgccaaatccccctctgtgagaaacacccaagaatgatcaataaaaaaaaaaaaaaaagaaa

SEQ ID NO: 3435 - DNA, 1528 bp, synthetic construct
  misc_feature 1..1528: note = Synthetic polypeptide
  source 1..1528: mol_type = other DNA
atgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagccgcctgccttggcctcccgaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcctggccgccatcccatctgggaagtgaggagcgcctcttcccggccgccatcacatctaggaagtgaggagcgtctctgcccggccgcccatcgtctgggatgtggggagtgcctctgccccgccgccctgtctgggatgtgaggagcgcctctgcccggccgccaccccgtctgggaggtgaggagcgtctctgcccagccgccccgtctgagaagtgaggagaccctccgcccggcagctgccccgtctgagaagtgaggagcctctccgcccggcagccaccccgtccgggagggaggtgggggggtcagccccccgcccggccagccgccccatccgggaggtgaggggtgcctctgcccggccgcccctactgggaagtgaggagcccctctgcccggccgcccctactgggaagtgaggagcccctctgcccggccaccaccccgtctgggaggtgtgcccaacagctcattgagaacgggccaggatgacaatggcggctttgcggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagagttaagtggattaagggcggtgcaagatgtgctttgttaaacagatgcttgaaggcagcatgctcattaagagtcatcaccactccctaatctcaagtacccagggacacaaacgctgtggaaggccgcagggtcctctgcctaggaaaaccagagacctttgttcacttgtttatctgctgaccttccctccactattgtcctgtgaccctgccaaatccccctctgtgagaaacacccaagaatgatcaataaaaaaaaaaaaaaaagaaa

SEQ ID NO: 3436 - DNA, 822 bp, synthetic construct; identical to SEQ ID NO: 119
  misc_feature 1..822: note = Synthetic polypeptide
  source 1..822: mol_type = other DNA

SEQ ID NO: 3437 - DNA, 3992 bp, synthetic construct; identical to SEQ ID NO: 120
  misc_feature 1..3992: note = Synthetic polypeptide
  source 1..3992: mol_type = other DNA

SEQ ID NO: 3438 - DNA, 3845 bp, synthetic construct; identical to SEQ ID NO: 121
  misc_feature 1..3845: note = Synthetic polypeptide
  source 1..3845: mol_type = other DNA

SEQ ID NO: 3439 - DNA, 1221 bp, synthetic construct; identical to SEQ ID NO: 122
  misc_feature 1..1221: note = Synthetic polypeptide
  source 1..1221: mol_type = other DNA

SEQ ID NO: 3440 - DNA, 1382 bp, synthetic construct; identical to SEQ ID NO: 1251
  misc_feature 1..1382: note = Synthetic polypeptide
  source 1..1382: mol_type = other DNA

SEQ ID NO: 3441 - DNA, 389 bp, synthetic construct
  misc_feature 1..389: note = Synthetic polypeptide
  source 1..389: mol_type = other DNA
atgcttgcagtggggcccgccatggacagggattacccgcagcatgaacccccgccggcgggcagcctcctgtacagcccgccgcccctgcagagcgccatgctgcactgcccctactggaacaccttctcgctgccgccataccctgccttctccagcgacagccgcccgttcatgagctccgcctccttcctcggcagccagccctgcccagacaccagctatgcccccgtggccaccgcctccagcttgccaccaaagacctgcgactttgctcaggacctgccgccgtgtcgcctctcatggcagacgggacctgcagatgggactgagtgatggacccaagacggaagagcttcctgggtgacctggaggcccagtgtcctcac

SEQ ID NO: 3442 - DNA, 1598 bp, synthetic construct; identical to SEQ ID NO: 1699
  misc_feature 1..1598: note = Synthetic polypeptide
  source 1..1598: mol_type = other DNA

SEQ ID NO: 3443 - DNA, 2874 bp, synthetic construct
  misc_feature 1..2874: note = Synthetic polypeptide
  source 1..2874: mol_type = other DNA
atgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtaatgatacttatgccaccgtttgtgagcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccagcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagaggtctacagcttcactcctgaggccagtgagaccacgaacccagtgagaggaatgagcgactccagatgcgccaccttaagagctgtaacactcaccacgaaggtctgcagcttcactcctgaagccagagagaccacgaacccaccagaaggaagaaactccaaacacatccgaacatcagaaggaacaaactctggacacaccacctttaagaactgtaacgctcaccacgagggtctgtggtttcattcttgaagtcagtcagaaaaagaacccaccagttccggaaaca

SEQ ID NO: 3444 - DNA, 2889 bp, synthetic construct
  misc_feature 1..2889: note = Synthetic polypeptide
  source 1..2889: mol_type = other DNA
atgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccaatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagaggtctacagcttcactcctgaggccagtgagaccacgaacccagtgagaggaatgagcgactccagatgcgccaccttaagagctgtaacactcaccacgaaggtctgcagcttcactcctgaagccagagagaccacgaacccaccagaaggaagaaactccaaacacatccgaacatcagaaggaacaaactctggacacaccacctttaagaactgtaacgctcaccacgagggtctgtggtttcattcttgaagtcagtcagaaaaagaacccaccagttccggaaaca

SEQ ID NO: 3445 - DNA, 1833 bp, synthetic construct; identical to SEQ ID NO: 126
  misc_feature 1..1833: note = Synthetic polypeptide
  source 1..1833: mol_type = other DNA

SEQ ID NO: 3446 - DNA, 2151 bp, synthetic construct; identical to SEQ ID NO: 127
  misc_feature 1..2151: note = Synthetic polypeptide
  source 1..2151: mol_type = other DNA

SEQ ID NO: 3447 - DNA, 1239 bp, synthetic construct; identical to SEQ ID NO: 129
  misc_feature 1..1239: note = Synthetic polypeptide
  source 1..1239: mol_type = other DNA

SEQ ID NO: 3448 - DNA, 1200 bp, synthetic construct; identical to SEQ ID NO: 130
  misc_feature 1..1200: note = Synthetic polypeptide
  source 1..1200: mol_type = other DNA

SEQ ID NO: 3449 - DNA, 776 bp, synthetic construct; identical to SEQ ID NO: 131
  misc_feature 1..776: note = Synthetic polypeptide
  source 1..776: mol_type = other DNA

SEQ ID NO: 3450 - DNA, 737 bp, synthetic construct; identical to SEQ ID NO: 132
  misc_feature 1..737: note = Synthetic polypeptide
  source 1..737: mol_type = other DNA

SEQ ID NO: 3451 - DNA, 1834 bp, synthetic construct; identical to SEQ ID NO: 133
  misc_feature 1..1834: note = Synthetic polypeptide
  source 1..1834: mol_type = other DNA

SEQ ID NO: 3452 - DNA, 1765 bp, synthetic construct; identical to SEQ ID NO: 135
  misc_feature 1..1765: note = Synthetic polypeptide
  source 1..1765: mol_type = other DNA

SEQ ID NO: 3453 - DNA, 645 bp, synthetic construct; identical to SEQ ID NO: 137
  misc_feature 1..645: note = Synthetic polypeptide
  source 1..645: mol_type = other DNA

SEQ ID NO: 3454 - DNA, 980 bp, synthetic construct; identical to SEQ ID NO: 139
  misc_feature 1..980: note = Synthetic polypeptide
  source 1..980: mol_type = other DNA

SEQ ID NO: 3455 - DNA, 1256 bp, synthetic construct; identical to SEQ ID NO: 140
  misc_feature 1..1256: note = Synthetic polypeptide
  source 1..1256: mol_type = other DNA

SEQ ID NO: 3456 - DNA, 1277 bp, synthetic construct; identical to SEQ ID NO: 142
  misc_feature 1..1277: note = Synthetic polypeptide
  source 1..1277: mol_type = other DNA

SEQ ID NO: 3457 - DNA, 128 bp, synthetic construct; identical to SEQ ID NO: 144
  misc_feature 1..128: note = Synthetic polypeptide
  source 1..128: mol_type = other DNA

SEQ ID NO: 3458 - DNA, 690 bp, synthetic construct; identical to SEQ ID NO: 145
  misc_feature 1..690: note = Synthetic polypeptide
  source 1..690: mol_type = other DNA

SEQ ID NO: 3459 - DNA, 803 bp, synthetic construct; identical to SEQ ID NO: 152
  misc_feature 1..803: note = Synthetic polypeptide
  source 1..803: mol_type = other DNA

SEQ ID NO: 3460 - DNA, 301 bp, synthetic construct; identical to SEQ ID NO: 147
  misc_feature 1..301: note = Synthetic polypeptide
  source 1..301: mol_type = other DNA

SEQ ID NO: 3461 - DNA, 303 bp, synthetic construct; identical to SEQ ID NO: 148
  misc_feature 1..303: note = Synthetic polypeptide
  source 1..303: mol_type = other DNA

SEQ ID NO: 3462 - DNA, 1094 bp, synthetic construct; identical to SEQ ID NO: 153
  misc_feature 1..1094: note = Synthetic polypeptide
  source 1..1094: mol_type = other DNA

SEQ ID NO: 3463 - DNA, 423 bp, synthetic construct; identical to SEQ ID NO: 154
  misc_feature 1..423: note = Synthetic polypeptide
  source 1..423: mol_type = other DNA

SEQ ID NO: 3464 - DNA, 1736 bp, synthetic construct; identical to SEQ ID NO: 156
  misc_feature 1..1736: note = Synthetic polypeptide
  source 1..1736: mol_type = other DNA

SEQ ID NO: 3465 - DNA, 1724 bp, synthetic construct; identical to SEQ ID NO: 157
  misc_feature 1..1724: note = Synthetic polypeptide
  source 1..1724: mol_type = other DNA

SEQ ID NO: 3466 - DNA, 3825 bp, synthetic construct; identical to SEQ ID NO: 158
  misc_feature 1..3825: note = Synthetic polypeptide
  source 1..3825: mol_type = other DNA

SEQ ID NO: 3467 - DNA, 572 bp, synthetic construct; identical to SEQ ID NO: 159
  misc_feature 1..572: note = Synthetic polypeptide
  source 1..572: mol_type = other DNA

SEQ ID NO: 3468 - DNA, 118 bp, synthetic construct; identical to SEQ ID NO: 162
  misc_feature 1..118: note = Synthetic polypeptide
  source 1..118: mol_type = other DNA

SEQ ID NO: 3469 - DNA, 1520 bp, synthetic construct; identical to SEQ ID NO: 175
  misc_feature 1..1520: note = Synthetic polypeptide
  source 1..1520: mol_type = other DNA

SEQ ID NO: 3470 - DNA, 1436 bp, synthetic construct; identical to SEQ ID NO: 176
  misc_feature 1..1436: note = Synthetic polypeptide
  source 1..1436: mol_type = other DNA

SEQ ID NO: 3471 - DNA, 1265 bp, synthetic construct; identical to SEQ ID NO: 177
  misc_feature 1..1265: note = Synthetic polypeptide
  source 1..1265: mol_type = other DNA

SEQ ID NO: 3472 - DNA, 610 bp, synthetic construct; identical to SEQ ID NO: 163
  misc_feature 1..610: note = Synthetic polypeptide
  source 1..610: mol_type = other DNA

SEQ ID NO: 3473 - DNA, 103 bp, synthetic construct; identical to SEQ ID NO: 173
  misc_feature 1..103: note = Synthetic polypeptide
  source 1..103: mol_type = other DNA

SEQ ID NO: 3474 - DNA, 681 bp, synthetic construct; identical to SEQ ID NO: 174
  misc_feature 1..681: note = Synthetic polypeptide
  source 1..681: mol_type = other DNA

SEQ ID NO: 3475 - DNA, 729 bp, synthetic construct; identical to SEQ ID NO: 202
  misc_feature 1..729: note = Synthetic polypeptide
  source 1..729: mol_type = other DNA

SEQ ID NO: 3476 - DNA, 500 bp, synthetic construct; identical to SEQ ID NO: 204
  misc_feature 1..500: note = Synthetic polypeptide
  source 1..500: mol_type = other DNA

SEQ ID NO: 3477 - DNA, 656 bp, synthetic construct; identical to SEQ ID NO: 205
  misc_feature 1..656: note = Synthetic polypeptide
  source 1..656: mol_type = other DNA

SEQ ID NO: 3478 - DNA, 524 bp, synthetic construct; identical to SEQ ID NO: 207
  misc_feature 1..524: note = Synthetic polypeptide
  source 1..524: mol_type = other DNA

SEQ ID NO: 3479 - DNA, 1363 bp, synthetic construct; identical to SEQ ID NO: 209
  misc_feature 1..1363: note = Synthetic polypeptide
  source 1..1363: mol_type = other DNA

SEQ ID NO: 3480 - DNA, 423 bp, synthetic construct; identical to SEQ ID NO: 179
  misc_feature 1..423: note = Synthetic polypeptide
  source 1..423: mol_type = other DNA

SEQ ID NO: 3481 - DNA, 657 bp, synthetic construct; identical to SEQ ID NO: 180
  misc_feature 1..657: note = Synthetic polypeptide
  source 1..657: mol_type = other DNA

SEQ ID NO: 3482 - DNA, 1313 bp, synthetic construct; identical to SEQ ID NO: 182
  misc_feature 1..1313: note = Synthetic polypeptide
  source 1..1313: mol_type = other DNA

SEQ ID NO: 3483 - DNA, 1253 bp, synthetic construct; identical to SEQ ID NO: 183
  misc_feature 1..1253: note = Synthetic polypeptide
  source 1..1253: mol_type = other DNA

SEQ ID NO: 3484 - DNA, 1259 bp, synthetic construct; identical to SEQ ID NO: 185
  misc_feature 1..1259: note = Synthetic polypeptide
  source 1..1259: mol_type = other DNA

SEQ ID NO: 3485 - DNA, 1250 bp, synthetic construct; identical to SEQ ID NO: 187
  misc_feature 1..1250: note = Synthetic polypeptide
  source 1..1250: mol_type = other DNA

SEQ ID NO: 3486 - DNA, 298 bp, synthetic construct; identical to SEQ ID NO: 190
  misc_feature 1..298: note = Synthetic polypeptide
  source 1..298: mol_type = other DNA

SEQ ID NO: 3487 - DNA, 316 bp, synthetic construct; identical to SEQ ID NO: 191
  misc_feature 1..316: note = Synthetic polypeptide
  source 1..316: mol_type = other DNA

SEQ ID NO: 3488 - DNA, 211 bp, synthetic construct; identical to SEQ ID NO: 193
  misc_feature 1..211: note = Synthetic polypeptide
  source 1..211: mol_type = other DNA

SEQ ID NO: 3489 - DNA, 439 bp, synthetic construct; identical to SEQ ID NO: 198
  misc_feature 1..439: note = Synthetic polypeptide
  source 1..439: mol_type = other DNA

SEQ ID NO: 3490 - DNA, 301 bp, synthetic construct; identical to SEQ ID NO: 199
  misc_feature 1..301: note = Synthetic polypeptide
  source 1..301: mol_type = other DNA

SEQ ID NO: 3491 - DNA, 478 bp, synthetic construct; identical to SEQ ID NO: 200
  misc_feature 1..478: note = Synthetic polypeptide
  source 1..478: mol_type = other DNA

SEQ ID NO: 3492 - DNA, 381 bp, synthetic construct; identical to SEQ ID NO: 201
  misc_feature 1..381: note = Synthetic polypeptide
  source 1..381: mol_type = other DNA

SEQ ID NO: 3493 - DNA, 2370 bp, synthetic construct; identical to SEQ ID NO: 210
  misc_feature 1..2370: note = Synthetic polypeptide
  source 1..2370: mol_type = other DNA

SEQ ID NO: 3494 - DNA, 2259 bp, synthetic construct; identical to SEQ ID NO: 212
  misc_feature 1..2259: note = Synthetic polypeptide
  source 1..2259: mol_type = other DNA

SEQ ID NO: 3495 - DNA, 775 bp, synthetic construct; identical to SEQ ID NO: 215
  misc_feature 1..775: note = Synthetic polypeptide
  source 1..775: mol_type = other DNA

SEQ ID NO: 3496 - DNA, 2153 bp, synthetic construct; identical to SEQ ID NO: 217
  misc_feature 1..2153: note = Synthetic polypeptide
  source 1..2153: mol_type = other DNA

SEQ ID NO: 3497 - DNA, 1766 bp, synthetic construct; identical to SEQ ID NO: 221
  misc_feature 1..1766: note = Synthetic polypeptide
  source 1..1766: mol_type = other DNA

SEQ ID NO: 3498 - DNA, 1664 bp, synthetic construct; identical to SEQ ID NO: 222
  misc_feature 1..1664: note = Synthetic polypeptide
  source 1..1664: mol_type = other DNA

SEQ ID NO: 3499 - DNA, 3525 bp, synthetic construct; identical to SEQ ID NO: 214
  misc_feature 1..3525: note = Synthetic polypeptide
  source 1..3525: mol_type = other DNA

SEQ ID NO: 3500 - DNA, 91 bp, synthetic construct; identical to SEQ ID NO: 223
  misc_feature 1..91: note = Synthetic polypeptide
  source 1..91: mol_type = other DNA

SEQ ID NO: 3501 - DNA, 1049 bp, synthetic construct; identical to SEQ ID NO: 224
  misc_feature 1..1049: note = Synthetic polypeptide
  source 1..1049: mol_type = other DNA

SEQ ID NO: 3502 - DNA, 499 bp, synthetic construct; identical to SEQ ID NO: 225
  misc_feature 1..499: note = Synthetic polypeptide
  source 1..499: mol_type = other DNA

SEQ ID NO: 3503 - DNA, 3220 bp, synthetic construct; identical to SEQ ID NO: 248
  misc_feature 1..3220: note = Synthetic polypeptide
  source 1..3220: mol_type = other DNA

SEQ ID NO: 3504 - DNA, 609 bp, synthetic construct; identical to SEQ ID NO: 249
  misc_feature 1..609: note = Synthetic polypeptide
  source 1..609: mol_type = other DNA

SEQ ID NO: 3505 - DNA, 738 bp, synthetic construct; identical to SEQ ID NO: 250
  misc_feature 1..738: note = Synthetic polypeptide
  source 1..738: mol_type = other DNA

SEQ ID NO: 3506 - DNA, 537 bp, synthetic construct; identical to SEQ ID NO: 251
  misc_feature 1..537: note = Synthetic polypeptide
  source 1..537: mol_type = other DNA

SEQ ID NO: 3507 - DNA, 684 bp, synthetic construct; identical to SEQ ID NO: 253
  misc_feature 1..684: note = Synthetic polypeptide
  source 1..684: mol_type = other DNA

SEQ ID NO: 3508 - DNA, 552 bp, synthetic construct; identical to SEQ ID NO: 254
  misc_feature 1..552: note = Synthetic polypeptide
  source 1..552: mol_type = other DNA

SEQ ID NO: 3509 - DNA, 285 bp, synthetic construct; identical to SEQ ID NO: 255
  misc_feature 1..285: note = Synthetic polypeptide
  source 1..285: mol_type = other DNA

SEQ ID NO: 3510 - DNA, 1416 bp, synthetic construct; identical to SEQ ID NO: 226
  misc_feature 1..1416: note = Synthetic polypeptide
  source 1..1416: mol_type = other DNA

SEQ ID NO: 3511 - DNA, 1027 bp, synthetic construct; identical to SEQ ID NO: 227
  misc_feature 1..1027: note = Synthetic polypeptide
  source 1..1027: mol_type = other DNA

SEQ ID NO: 3512 - DNA, 1114 bp, synthetic construct; identical to SEQ ID NO: 228
  misc_feature 1..1114: note = Synthetic polypeptide
  source 1..1114: mol_type = other DNA

SEQ ID NO: 3513 - DNA, 553 bp, synthetic construct; identical to SEQ ID NO: 229
  misc_feature 1..553: note = Synthetic polypeptide
  source 1..553: mol_type = other DNA

SEQ ID NO: 3514 - DNA, 1156 bp, synthetic construct; identical to SEQ ID NO: 231
  misc_feature 1..1156: note = Synthetic polypeptide
  source 1..1156: mol_type = other DNA

SEQ ID NO: 3515 - DNA, 985 bp, synthetic construct; identical to SEQ ID NO: 232
  misc_feature 1..985: note = Synthetic polypeptide
  source 1..985: mol_type = other DNA

SEQ ID NO: 3516 - DNA, 1069 bp, synthetic construct; identical to SEQ ID NO: 233
  misc_feature 1..1069: note = Synthetic polypeptide
  source 1..1069: mol_type = other DNA

SEQ ID NO: 3517 - DNA, 1072 bp, synthetic construct; identical to SEQ ID NO: 234
  misc_feature 1..1072: note = Synthetic polypeptide
  source 1..1072: mol_type = other DNA

SEQ ID NO: 3518 - DNA, 943 bp, synthetic construct; identical to SEQ ID NO: 236
  misc_feature 1..943: note = Synthetic polypeptide
  source 1..943: mol_type = other DNA

SEQ ID NO: 3519 - DNA, 459 bp, synthetic construct; identical to SEQ ID NO: 237
  misc_feature 1..459: note = Synthetic polypeptide
  source 1..459: mol_type = other DNA

SEQ ID NO: 3520 - DNA, 3321 bp, synthetic construct; identical to SEQ ID NO: 242
  misc_feature 1..3321: note = Synthetic polypeptide
  source 1..3321: mol_type = other DNA

SEQ ID NO: 3521 - DNA, 3429 bp, synthetic construct; identical to SEQ ID NO: 243
  misc_feature 1..3429: note = Synthetic polypeptide
  source 1..3429: mol_type = other DNA

SEQ ID NO: 3522 - DNA, 3456 bp, synthetic construct; identical to SEQ ID NO: 244
  misc_feature 1..3456: note = Synthetic polypeptide
  source 1..3456: mol_type = other DNA

SEQ ID NO: 3523 - DNA, 327 bp, synthetic construct; identical to SEQ ID NO: 246
  misc_feature 1..327: note = Synthetic polypeptide
  source 1..327: mol_type = other DNA

SEQ ID NO: 3524 - DNA, 1052 bp, synthetic construct; identical to SEQ ID NO: 247
  misc_feature 1..1052: note = Synthetic polypeptide
  source 1..1052: mol_type = other DNA

SEQ ID NO: 3525 - DNA, 82 bp, synthetic construct; identical to SEQ ID NO: 257
  misc_feature 1..82: note = Synthetic polypeptide
  source 1..82: mol_type = other DNA

SEQ ID NO: 3526 - DNA, 102 bp, synthetic construct; identical to SEQ ID NO: 258
  misc_feature 1..102: note = Synthetic polypeptide
  source 1..102: mol_type = other DNA

SEQ ID NO: 3527 - DNA, 1209 bp, synthetic construct; identical to SEQ ID NO: 281
  misc_feature 1..1209: note = Synthetic polypeptide
  source 1..1209: mol_type = other DNA

SEQ ID NO: 3528 - DNA, 1206 bp, synthetic construct; identical to SEQ ID NO: 282
  misc_feature 1..1206: note = Synthetic polypeptide
  source 1..1206: mol_type = other DNA

SEQ ID NO: 3529 - DNA, 1203 bp, synthetic construct; identical to SEQ ID NO: 286
  misc_feature 1..1203: note = Synthetic polypeptide
  source 1..1203: mol_type = other DNA

SEQ ID NO: 3530 - DNA, 55 bp, synthetic construct; identical to SEQ ID NO: 291
  misc_feature 1..55: note = Synthetic polypeptide
  source 1..55: mol_type = other DNA

SEQ ID NO: 3531 - DNA, 25 bp, synthetic construct
  misc_feature 1..25: note = Synthetic polypeptide
  source 1..25: mol_type = other DNA
atgagcgtcctttcgtttttttaaa

SEQ ID NO: 3532 - DNA, 763 bp, synthetic construct; identical to SEQ ID NO: 261
  misc_feature 1..763: note = Synthetic polypeptide
  source 1..763: mol_type = other DNA

SEQ ID NO: 3533 - DNA, 646 bp, synthetic construct; identical to SEQ ID NO: 262
  misc_feature 1..646: note = Synthetic polypeptide
  source 1..646: mol_type = other DNA

SEQ ID NO: 3534 - DNA, 258 bp, synthetic construct; identical to SEQ ID NO: 265
  misc_feature 1..258: note = Synthetic polypeptide
  source 1..258: mol_type = other DNA

SEQ ID NO: 3535 - DNA, 243 bp, synthetic construct; identical to SEQ ID NO: 267
  misc_feature 1..243: note = Synthetic polypeptide
  source 1..243: mol_type = other DNA

SEQ ID NO: 3536 - DNA, 324 bp, synthetic construct; identical to SEQ ID NO: 268
  misc_feature 1..324: note = Synthetic polypeptide
  source 1..324: mol_type = other DNA

SEQ ID NO: 3537 - DNA, 728 bp, synthetic construct; identical to SEQ ID NO: 269
  misc_feature 1..728: note = Synthetic polypeptide
  source 1..728: mol_type = other DNA

SEQ ID NO: 3538 - DNA, 663 bp, synthetic construct; identical to SEQ ID NO: 271
  misc_feature 1..663: note = Synthetic polypeptide
  source 1..663: mol_type = other DNA

SEQ ID NO: 3539 - DNA, 1682 bp, synthetic construct; identical to SEQ ID NO: 272
  misc_feature 1..1682: note = Synthetic polypeptide
  source 1..1682: mol_type = other DNA

SEQ ID NO: 3540 - DNA, 1199 bp, synthetic construct; identical to SEQ ID NO: 273
  misc_feature 1..1199: note = Synthetic polypeptide
  source 1..1199: mol_type = other DNA

SEQ ID NO: 3541 - DNA, 76 bp, synthetic construct; identical to SEQ ID NO: 274
  misc_feature 1..76: note = Synthetic polypeptide
  source 1..76: mol_type = other DNA

SEQ ID NO: 3542 - DNA, 282 bp, synthetic construct; identical to SEQ ID NO: 277
  misc_feature 1..282: note = Synthetic polypeptide
  source 1..282: mol_type = other DNA

SEQ ID NO: 3543 - DNA, 386 bp, synthetic construct; identical to SEQ ID NO: 278
  misc_feature 1..386: note = Synthetic polypeptide
  source 1..386: mol_type = other DNA

SEQ ID NO: 3544 - DNA, 423 bp, synthetic construct; identical to SEQ ID NO: 279
  misc_feature 1..423: note = Synthetic polypeptide
  source 1..423: mol_type = other DNA

SEQ ID NO: 3545 - DNA, 320 bp, synthetic construct; identical to SEQ ID NO: 280
  misc_feature 1..320: note = Synthetic polypeptide
  source 1..320: mol_type = other DNA

SEQ ID NO: 3546 - DNA, 529 bp, synthetic construct; identical to SEQ ID NO: 287
  misc_feature 1..529: note = Synthetic polypeptide
  source 1..529: mol_type = other DNA

SEQ ID NO: 3547 - DNA, 2161 bp, synthetic construct; identical to SEQ ID NO: 288
  misc_feature 1..2161: note = Synthetic polypeptide
  source 1..2161: mol_type = other DNA

SEQ ID NO: 3548 - DNA, 2140 bp, synthetic construct; identical to SEQ ID NO: 289
  misc_feature 1..2140: note = Synthetic polypeptide
  source 1..2140: mol_type = other DNA

SEQ ID NO: 3549 - DNA, 377 bp, synthetic construct; identical to SEQ ID NO: 299
  misc_feature 1..377: note = Synthetic polypeptide
  source 1..377: mol_type = other DNA

SEQ ID NO: 3550 - DNA, 377 bp, synthetic construct; identical to SEQ ID NO: 300
  misc_feature 1..377: note = Synthetic polypeptide
  source 1..377: mol_type = other DNA

SEQ ID NO: 3551 - DNA, 1072 bp, synthetic construct; identical to SEQ ID NO: 307
  misc_feature 1..1072: note = Synthetic polypeptide
  source 1..1072: mol_type = other DNA

SEQ ID NO: 3552 - DNA, 1055 bp, synthetic construct; identical to SEQ ID NO: 306
  misc_feature 1..1055: note = Synthetic polypeptide
  source 1..1055: mol_type = other DNA

SEQ ID NO: 3553 - DNA, 503 bp, synthetic construct; identical to SEQ ID NO: 322
  misc_feature 1..503: note = Synthetic polypeptide
  source 1..503: mol_type = other DNA

SEQ ID NO: 3554 - DNA, 1606 bp, synthetic construct; identical to SEQ ID NO: 327
  misc_feature 1..1606: note = Synthetic polypeptide
  source 1..1606: mol_type = other DNA

SEQ ID NO: 3555 - DNA, 175 bp, synthetic construct; identical to SEQ ID NO: 329
  misc_feature 1..175: note = Synthetic polypeptide
  source 1..175: mol_type = other DNA

SEQ ID NO: 3556 - DNA, 3628 bp, synthetic construct; identical to SEQ ID NO: 330
  misc_feature 1..3628: note = Synthetic polypeptide
  source 1..3628: mol_type = other DNA

SEQ ID NO: 3557 - DNA, 3127 bp, synthetic construct; identical to SEQ ID NO: 332
  misc_feature 1..3127: note = Synthetic polypeptide
  source 1..3127: mol_type = other DNA

SEQ ID NO: 3558 - DNA, 137 bp, synthetic construct; identical to SEQ ID NO: 336
  misc_feature 1..137: note = Synthetic polypeptide
  source 1..137: mol_type = other DNA

SEQ ID NO: 3559 - DNA, 451 bp, synthetic construct; identical to SEQ ID NO: 339
  misc_feature 1..451: note = Synthetic polypeptide
  source 1..451: mol_type = other DNA

SEQ ID NO: 3560 - DNA, 3093 bp, synthetic construct; identical to SEQ ID NO: 341
  misc_feature 1..3093: note = Synthetic polypeptide
  source 1..3093: mol_type = other DNA

SEQ ID NO: 3561 - DNA, 2979 bp, synthetic construct; identical to SEQ ID NO: 342
  misc_feature 1..2979: note = Synthetic polypeptide
  source 1..2979: mol_type = other DNA

SEQ ID NO: 3562 - DNA, 3078 bp, synthetic construct; identical to SEQ ID NO: 343
  misc_feature 1..3078: note = Synthetic polypeptide
  source 1..3078: mol_type = other DNA

SEQ ID NO: 3563 - DNA, 3072 bp, synthetic construct; identical to SEQ ID NO: 346
  misc_feature 1..3072: note = Synthetic polypeptide
  source 1..3072: mol_type = other DNA

SEQ ID NO: 3564 - DNA, 1935 bp, synthetic construct; identical to SEQ ID NO: 347
  misc_feature 1..1935: note = Synthetic polypeptide
  source 1..1935: mol_type = other DNA

SEQ ID NO: 3565 - DNA, 1096 bp, synthetic construct; identical to SEQ ID NO: 348
  misc_feature 1..1096: note = Synthetic polypeptide
  source 1..1096: mol_type = other DNA

SEQ ID NO: 3566 - DNA, 902 bp, synthetic construct; identical to SEQ ID NO: 349
  misc_feature 1..902: note = Synthetic polypeptide
  source 1..902: mol_type = other DNA

SEQ ID NO: 3567 - DNA, 874 bp, synthetic construct; identical to SEQ ID NO: 350
  misc_feature 1..874: note = Synthetic polypeptide
  source 1..874: mol_type = other DNA

SEQ ID NO: 3568 - DNA, 196 bp, synthetic construct; identical to SEQ ID NO: 310
  misc_feature 1..196: note = Synthetic polypeptide
  source 1..196: mol_type = other DNA

SEQ ID NO: 3569 - DNA, 355 bp, synthetic construct; identical to SEQ ID NO: 314
  misc_feature 1..355: note = Synthetic polypeptide
  source 1..355: mol_type = other DNA

SEQ ID NO: 3570 - DNA, 225 bp, synthetic construct; identical to SEQ ID NO: 315
  misc_feature 1..225: note = Synthetic polypeptide
  source 1..225: mol_type = other DNA

SEQ ID NO: 3571 - DNA, 516 bp, synthetic construct; identical to SEQ ID NO: 317
  misc_feature 1..516: note = Synthetic polypeptide
  source 1..516: mol_type = other DNA

SEQ ID NO: 3572 - DNA, 890 bp, synthetic construct; identical to SEQ ID NO: 319
  misc_feature 1..890: note = Synthetic polypeptide
  source 1..890: mol_type = other DNA

SEQ ID NO: 3573 - DNA, 947 bp, synthetic construct; identical to SEQ ID NO: 320
  misc_feature 1..947: note = Synthetic polypeptide
  source 1..947: mol_type = other DNA

SEQ ID NO: 3574 - DNA, 637 bp, synthetic construct; identical to SEQ ID NO: 324
  misc_feature 1..637: note = Synthetic polypeptide
  source 1..637: mol_type = other DNA

SEQ ID NO: 3575 - DNA, 950 bp, synthetic construct; identical to SEQ ID NO: 325
  misc_feature 1..950: note = Synthetic polypeptide
  source 1..950: mol_type = other DNA

SEQ ID NO: 3576 - DNA, 1324 bp, synthetic construct; identical to SEQ ID NO: 326
  misc_feature 1..1324: note = Synthetic polypeptide
  source 1..1324: mol_type = other DNA

SEQ ID NO: 3577 - DNA, 819 bp, synthetic construct; identical to SEQ ID NO: 333
  misc_feature 1..819: note = Synthetic polypeptide
  source 1..819: mol_type = other DNA

SEQ ID NO: 3578 - DNA, 876 bp, synthetic construct; identical to SEQ ID NO: 334
  misc_feature 1..876: note = Synthetic polypeptide
  source 1..876: mol_type = other DNA

SEQ ID NO: 3579 - DNA, 5853 bp, synthetic construct; identical to SEQ ID NO: 376
  misc_feature 1..5853: note = Synthetic polypeptide
  source 1..5853: mol_type = other DNA

SEQ ID NO: 3580 - DNA, 5829 bp, synthetic construct; identical to SEQ ID NO: 377
  misc_feature 1..5829: note = Synthetic polypeptide
  source 1..5829: mol_type = other DNA

SEQ ID NO: 3581 - DNA, 1950 bp, synthetic construct; identical to SEQ ID NO: 378
  misc_feature 1..1950: note = Synthetic polypeptide
  source 1..1950: mol_type = other DNA

SEQ ID NO: 3582 - DNA, 2072 bp, synthetic construct; identical to SEQ ID NO: 379
  misc_feature 1..2072: note = Synthetic polypeptide
  source 1..2072: mol_type = other DNA

SEQ ID NO: 3583 - DNA, 390 bp, synthetic construct; identical to SEQ ID NO: 380
  misc_feature 1..390: note = Synthetic polypeptide
  source 1..390: mol_type = other DNA

SEQ ID NO: 3584 - DNA, 299 bp, synthetic construct; identical to SEQ ID NO: 383
  misc_feature 1..299: note = Synthetic polypeptide
  source 1..299: mol_type = other DNA

SEQ ID NO: 3585 - DNA, 150 bp, synthetic construct; identical to SEQ ID NO: 384
  misc_feature 1..150: note = Synthetic polypeptide
  source 1..150: mol_type = other DNA

SEQ ID NO: 3586 - DNA, 445 bp, synthetic construct; identical to SEQ ID NO: 387
  misc_feature 1..445: note = Synthetic polypeptide
  source 1..445: mol_type = other DNA

SEQ ID NO: 3587 - DNA, 337 bp, synthetic construct; identical to SEQ ID NO: 390
  misc_feature 1..337: note = Synthetic polypeptide
  source 1..337: mol_type = other DNA

SEQ ID NO: 3588 - DNA, 586 bp, synthetic construct; identical to SEQ ID NO: 401
  misc_feature 1..586: note = Synthetic polypeptide
  source 1..586: mol_type = other DNA

SEQ ID NO: 3589 - DNA, 829 bp, synthetic construct; identical to SEQ ID NO: 402
  misc_feature 1..829: note = Synthetic polypeptide
  source 1..829: mol_type = other DNA

SEQ ID NO: 3590 - DNA, 1060 bp, synthetic construct; identical to SEQ ID NO: 403
  misc_feature 1..1060: note = Synthetic polypeptide
  source 1..1060: mol_type = other DNA

SEQ ID NO: 3591 - DNA, 730 bp, synthetic construct; identical to SEQ ID NO: 406
  misc_feature 1..730: note = Synthetic polypeptide
  source 1..730: mol_type = other DNA

SEQ ID NO: 3592 - DNA, 496 bp, synthetic construct; identical to SEQ ID NO: 408
  misc_feature 1..496: note = Synthetic polypeptide
  source 1..496: mol_type = other DNA

SEQ ID NO: 3593 - DNA, 392 bp, synthetic construct; identical to SEQ ID NO: 410
  misc_feature 1..392: note = Synthetic polypeptide
  source 1..392: mol_type = other DNA

SEQ ID NO: 3594 - DNA, 1290 bp, synthetic construct; identical to SEQ ID NO: 425
  misc_feature 1..1290: note = Synthetic polypeptide
  source 1..1290: mol_type = other DNA

SEQ ID NO: 3595 - DNA, 569 bp, synthetic construct; identical to SEQ ID NO: 426
  misc_feature 1..569: note = Synthetic polypeptide
  source 1..569: mol_type = other DNA

SEQ ID NO: 3596 - DNA, 247 bp, synthetic construct; identical to SEQ ID NO: 427
  misc_feature 1..247: note = Synthetic polypeptide
  source 1..247: mol_type = other DNA

SEQ ID NO: 3597 - DNA, 163 bp, synthetic construct; identical to SEQ ID NO: 351
  misc_feature 1..163: note = Synthetic polypeptide
  source 1..163: mol_type = other DNA

SEQ ID NO: 3598 - DNA, 222 bp, synthetic construct; identical to SEQ ID NO: 355
  misc_feature 1..222: note = Synthetic polypeptide
  source 1..222: mol_type = other DNA

SEQ ID NO: 3599 - DNA, 552 bp, synthetic construct; identical to SEQ ID NO: 356
  misc_feature 1..552: note = Synthetic polypeptide
  source 1..552: mol_type = other DNA

SEQ ID NO: 3600 - DNA, 387 bp, synthetic construct; identical to SEQ ID NO: 359
  misc_feature 1..387: note = Synthetic polypeptide
  source 1..387: mol_type = other DNA

SEQ ID NO: 3601 - DNA, 444 bp, synthetic construct; identical to SEQ ID NO: 360
  misc_feature 1..444: note = Synthetic polypeptide
  source 1..444: mol_type = other DNA

SEQ ID NO: 3602 - DNA, 431 bp, synthetic construct; identical to SEQ ID NO: 364
  misc_feature 1..431: note = Synthetic polypeptide
  source 1..431: mol_type = other DNA

SEQ ID NO: 3603 - DNA, 739 bp, synthetic construct; identical to SEQ ID NO: 365
  misc_feature 1..739: note = Synthetic polypeptide
  source 1..739: mol_type = other DNA

SEQ ID NO: 3604 - DNA, 865 bp, synthetic construct; identical to SEQ ID NO: 366
  misc_feature 1..865: note = Synthetic polypeptide
  source 1..865: mol_type = other DNA

SEQ ID NO: 3605 - DNA, 719 bp, synthetic construct; identical to SEQ ID NO: 367
  misc_feature 1..719: note = Synthetic polypeptide
  source 1..719: mol_type = other DNA

SEQ ID NO: 3606 - DNA, 716 bp, synthetic construct; identical to SEQ ID NO: 369
  misc_feature 1..716: note = Synthetic polypeptide
  source 1..716: mol_type = other DNA

SEQ ID NO: 3607 - DNA, 683 bp, synthetic construct; identical to SEQ ID NO: 372
  misc_feature 1..683: note = Synthetic polypeptide
  source 1..683: mol_type = other DNA

SEQ ID NO: 3608 - DNA, 910 bp, synthetic construct; identical to SEQ ID NO: 391
  misc_feature 1..910: note = Synthetic polypeptide
  source 1..910: mol_type = other DNA

SEQ ID NO: 3609 - DNA, 997 bp, synthetic construct; identical to SEQ ID NO: 392
  misc_feature 1..997: note = Synthetic polypeptide
  source 1..997: mol_type = other DNA

SEQ ID NO: 3610 - DNA, 436 bp, synthetic construct; identical to SEQ ID NO: 393
  misc_feature 1..436: note = Synthetic polypeptide
  source 1..436: mol_type = other DNA

SEQ ID NO: 3611 - DNA, 1039 bp, synthetic construct; identical to SEQ ID NO: 395
  misc_feature 1..1039: note = Synthetic polypeptide
  source 1..1039: mol_type = other DNA

SEQ ID NO: 3612 - DNA, 868 bp, synthetic construct; identical to SEQ ID NO: 396
  misc_feature 1..868: note = Synthetic polypeptide
  source 1..868: mol_type = other DNA

SEQ ID NO: 3613 - DNA, 952 bp, synthetic construct; identical to SEQ ID NO: 397
  misc_feature 1..952: note = Synthetic polypeptide
  source 1..952: mol_type = other DNA

SEQ ID NO: 3614 - DNA, 955 bp, synthetic construct; identical to SEQ ID NO: 398
  misc_feature 1..955: note = Synthetic polypeptide
  source 1..955: mol_type = other DNA

SEQ ID NO: 3615 - DNA, 826 bp, synthetic construct; identical to SEQ ID NO: 400
  misc_feature 1..826: note = Synthetic polypeptide
  source 1..826: mol_type = other DNA

SEQ ID NO: 3616 - DNA, 441 bp, synthetic construct; identical to SEQ ID NO: 409
  misc_feature 1..441: note = Synthetic polypeptide
  source 1..441: mol_type = other DNA

SEQ ID NO: 3617 - DNA, 721 bp, synthetic construct; identical to SEQ ID NO: 414
  misc_feature 1..721: note = Synthetic polypeptide
  source 1..721: mol_type = other DNA

SEQ ID NO: 3618 - DNA, 1332 bp, synthetic construct; identical to SEQ ID NO: 422
  misc_feature 1..1332: note = Synthetic polypeptide
  source 1..1332: mol_type = other DNA

SEQ ID NO: 3619 - DNA, 1254 bp, synthetic construct; identical to SEQ ID NO: 423
  misc_feature 1..1254: note = Synthetic polypeptide
  source 1..1254: mol_type = other DNA

SEQ ID NO: 3620 - DNA, 3308 bp, synthetic construct; identical to SEQ ID NO: 428
  misc_feature 1..3308: note = Synthetic polypeptide
  source 1..3308: mol_type = other DNA

SEQ ID NO: 3621 - DNA, 3203 bp, synthetic construct; identical to SEQ ID NO: 429
  misc_feature 1..3203: note = Synthetic polypeptide
  source 1..3203: mol_type = other DNA

SEQ ID NO: 3622 - DNA, 2849 bp, synthetic construct; identical to SEQ ID NO: 430
  misc_feature 1..2849: note = Synthetic polypeptide
  source 1..2849: mol_type = other DNA

SEQ ID NO: 3623 - DNA, 388 bp, synthetic construct; identical to SEQ ID NO: 431
  misc_feature 1..388: note = Synthetic polypeptide
  source 1..388: mol_type = other DNA

SEQ ID NO: 3624 - DNA, 822 bp, synthetic construct; identical to SEQ ID NO: 119
  misc_feature 1..822: note = Synthetic polypeptide
  source 1..822: mol_type = other DNA

SEQ ID NO: 3625 - DNA, 822 bp, synthetic construct; identical to SEQ ID NO: 119
  misc_feature 1..822: note = Synthetic polypeptide
  source 1..822: mol_type = other DNA

SEQ ID NO: 3626 - DNA, 881 bp, synthetic construct; identical to SEQ ID NO: 2412
  misc_feature 1..881: note = Synthetic polypeptide
  source 1..881: mol_type = other DNA

SEQ ID NO: 3627 - DNA, 803 bp, synthetic construct; identical to SEQ ID NO: 2413
  misc_feature 1..803: note = Synthetic polypeptide
  source 1..803: mol_type = other DNA

SEQ ID NO: 3628 - DNA, 610 bp, synthetic construct; identical to SEQ ID NO: 163
  misc_feature 1..610: note = Synthetic polypeptide
  source 1..610: mol_type = other DNA

SEQ ID NO: 3629 - DNA, 999 bp, synthetic construct; identical to SEQ ID NO: 983
  misc_feature 1..999: note = Synthetic polypeptide
  source 1..999: mol_type = other DNA

SEQ ID NO: 3630 - DNA, 603 bp, synthetic construct; identical to SEQ ID NO: 1012
  misc_feature 1..603: note = Synthetic polypeptide
  source 1..603: mol_type = other DNA

SEQ ID NO: 3631 - DNA, 567 bp, synthetic construct
  misc_feature 1..567: note = Synthetic polypeptide
  source 1..567: mol_type = other DNA
atggaagccccggagggcggaggggggcctgcagcgcggggcccggagggcccggcgcccgaagccagggtgcacttccgagtggcgaggttcatcatggaggcaggaggctaaatattgatttcccaaagatgtccctatcctaatccctggaacctgtgaatgtcatcttatatagcaaaagagattttgaagatgtgattagagaccttaagatgggagatcatcctagattatctgggtgtaaccacacccatccttataaggcaaaggcaggaggagtcaccgtcagagaaggccacgtgaggacagaagcagagttagaagctttgaagatggaggaaggggccagcaaccaaggaatgcagccctcctctagaagctggaaaaggcaaggaaacattctcccatggagcctccagaaggagccagccctgcttagacgttgatcttagctttctaggctagttttggacttctgacttccaggatcggaggagtataaatgtgtgttgtttaagtggctgaatttgtggtgatttgttgcagtagccctagggaactgat

SEQ ID NO: 3632 - DNA, 1753 bp, synthetic construct; identical to SEQ ID NO: 2406
  misc_feature 1..1753: note = Synthetic polypeptide
  source 1..1753: mol_type = other DNA

SEQ ID NO: 3633 - DNA, 1155 bp, synthetic construct; identical to SEQ ID NO: 2407
  misc_feature 1..1155: note = Synthetic polypeptide
  source 1..1155: mol_type = other DNA

SEQ ID NO: 3634 - DNA, 193 bp, synthetic construct; identical to SEQ ID NO: 975
  misc_feature 1..193: note = Synthetic polypeptide
  source 1..193: mol_type = other DNA

SEQ ID NO: 3635 - DNA, 371 bp, synthetic construct; identical to SEQ ID NO: 1008
  misc_feature 1..371: note = Synthetic polypeptide
  source 1..371: mol_type = other DNA

SEQ ID NO: 3636 - DNA, 272 bp, synthetic construct; identical to SEQ ID NO: 1009
  misc_feature 1..272: note = Synthetic polypeptide
  source 1..272: mol_type = other DNA

SEQ ID NO: 3637 - DNA, 2312 bp, synthetic construct; identical to SEQ ID NO: 1998
  misc_feature 1..2312: note = Synthetic polypeptide
  source 1..2312: mol_type = other DNA

SEQ ID NO: 3638 - DNA, 1398 bp, synthetic construct; identical to SEQ ID NO: 948
  misc_feature 1..1398: note = Synthetic polypeptide
  source 1..1398: mol_type = other DNA

SEQ ID NO: 3639 - DNA, 1302 bp, synthetic construct; identical to SEQ ID NO: 949
  misc_feature 1..1302: note = Synthetic polypeptide
  source 1..1302: mol_type = other DNA

SEQ ID NO: 3640 - DNA, 721 bp, synthetic construct; identical to SEQ ID NO: 414
  misc_feature 1..721: note = Synthetic polypeptide
  source 1..721: mol_type = other DNA

SEQ ID NO: 3641 - DNA, 143 bp, synthetic construct; identical to SEQ ID NO: 1010
  misc_feature 1..143: note = Synthetic polypeptide
  source 1..143: mol_type = other DNA

SEQ ID NO: 3642 - DNA, 314 bp, synthetic construct; identical to SEQ ID NO: 1011
  misc_feature 1..314: note = Synthetic polypeptide
  source 1..314: mol_type = other DNA

SEQ ID NO: 3643 - DNA, 714 bp, synthetic construct
  misc_feature 1..714: note = Synthetic polypeptide
  source 1..714: mol_type = other DNA
atgctgccgtgcgccgcgggagccagggggcgtggggccatggtggtcttgcgggcggggaagaagacctttctcccccctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtgcagtggctcactcctgtaatcccagcactctgggaggccaaggcgggcggatcatgaagtcaggagttcaagaccagtctgaccgatgtggtgaaaccccgtctttactagaaatacaaaaattagccaggtatggtggtgcgtgcctgtaatcccagctactcaggaggctgaggcaggagaatcgcttgaacccagaaggcagagtttgcagtgagccgagattgcgccactgcactccagcctgggtgacagagcaagactctgtctctaaataaataaataaa

SEQ ID NO: 3644 - DNA, 675 bp, synthetic construct
  misc_feature 1..675: note = Synthetic polypeptide
  source 1..675: mol_type = other DNA
atggtggtcttgcgggcggggaagaagacctttctcccccctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtgcagtggctcactcctgtaatcccagcactctgggaggccaaggcgggcggatcatgaagtcaggagttcaagaccagtctgaccgatgtggtgaaaccccgtctttactagaaatacaaaaattagccaggtatggtggtgcgtgcctgtaatcccagctactcaggaggctgaggcaggagaatcgcttgaacccagaaggcagagtttgcagtgagccgagattgcgccactgcactccagcctgggtgacagagcaagactctgtctctaaataaataaataaa

SEQ ID NO: 3645 - DNA, 600 bp, synthetic construct
  misc_feature 1..600: note = Synthetic polypeptide
  source 1..600: mol_type = other DNA
ctcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtgcagtggctcactcctgtaatcccagcactctgggaggccaaggcgggcggatcatgaagtcaggagttcaagaccagtctgaccgatgtggtgaaaccccgtctttactagaaatacaaaaattagccaggtatggtggtgcgtgcctgtaatcccagctactcaggaggctgaggcaggagaatcgcttgaacccagaaggcagagtttgcagtgagccgagattgcgccactgcactccagcctgggtgacagagcaagactctgtctctaaataaataaataaa

SEQ ID NO: 3646 - DNA, 572 bp, synthetic construct; identical to SEQ ID NO: 159
  misc_feature 1..572: note = Synthetic polypeptide
  source 1..572: mol_type = other DNA

SEQ ID NO: 3647 - DNA, 14 bp, synthetic construct
  misc_feature 1..14: note = Synthetic polypeptide
  source 1..14: mol_type = other DNA
ccgacttctggaga

SEQ ID NO: 3648 - DNA, 39 bp, synthetic construct
  misc_feature 1..39: note = Synthetic polypeptide
  source 1..39: mol_type = other DNA
atgagtaacgtgaatttgtccgtctccgacttctggaga

SEQ ID NO: 3649 - DNA, 464 bp, synthetic construct; identical to SEQ ID NO: 1863
  misc_feature 1..464: note = Synthetic polypeptide
  source 1..464: mol_type = other DNA

SEQ ID NO: 3650 - DNA, 202 bp, synthetic construct
  misc_feature 1..202: note = Synthetic polypeptide
  source 1..202: mol_type = other DNA
atggagaaaatcattcaagtggccaagacctctgctgcacaggcttataggcggaagggacttgccttgtctcagacgagatgttggactgtggacttttgagttaatgctaaaataagttaagactttgagggactgttgggaaggcatgattggtttcaaaatgtgaggacatgagatttaggagggatgaggagcggaa

SEQ ID NO: 3651 - DNA, 388 bp, synthetic construct
  misc_feature 1..388: note = Synthetic polypeptide
  source 1..388: mol_type = other DNA
atggcggcggcctctgcggtgtcggtgctgctggtggcggcggagaggaaccggtggcatcgtctcccgagcctgctcctgccgccgaggacatgggtgtggaggcaaagaaccatgaagtacacaacagccacagatgaagcatattccatcggccccgctccctcccagcagagctacctatctatggagaaaatcattcaagtggccaagacctctgctgcacaggcttataggcggaagggacttgccttgtctcagacgagatgttggactgtggacttttgagttaatgctaaaataagttaagactttgagggactgttgggaaggcatgattggtttcaaaatgtgaggacatgagatttaggagggatgaggagcggaa

SEQ ID NO: 3652 - DNA, 529 bp, synthetic construct
  misc_feature 1..529: note = Synthetic polypeptide
  source 1..529: mol_type = other DNA
atggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggcttataggcggaagggacttgccttgtctcagacgagatgttggactgtggacttttgagttaatgctaaaataagttaagactttgagggactgttgggaaggcatgattggtttcaaaatgtgaggacatgagatttaggagggatgaggagcggaa

SEQ ID NO: 3653 - DNA, 415 bp, synthetic construct
  misc_feature 1..415: note = Synthetic polypeptide
  source 1..415: mol_type = other DNA
atgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggcttataggcggaagggacttgccttgtctcagacgagatgttggactgtggacttttgagttaatgctaaaataagttaagactttgagggactgttgggaaggcatgattggtttcaaaatgtgaggacatgagatttaggagggatgaggagcggaa

SEQ ID NO: 3654 - DNA, 2848 bp, synthetic construct
  misc_feature 1..2848: note = Synthetic polypeptide
  source 1..2848: mol_type = other DNA
atggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggaggctcgtaggaatactctcataaaagataccatgagggaacagtgcattccaaatctggtggaatcatggtaccaaatattacaaaattatcagtttactaattctgaagtgacgtgtcagtgccttgaagtagttggggcttatgtctcttggatagacttatcccttatagccaatgataggtttataaatatgctgctaggtcatatgtcaatagaagttctacgggaagaagcatgtgactgtttatttgaagttgtaaataaaggaatggaccctgttgataaaatgaaactagtggaatctttgtgtcaagtattacagtctgctgggtttttcagcattgaccaggaagaagatgttgacttcctggccagattttctaagttggtaaatggaatgggacagtcattgatagttagttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacagcttacagtgctctcggatcagcaaaaagctaatgtagaggcaatcatgttggccgttatgaaaaaattgacttacgatgaagaatataactttgaaaatgagggtgaagatgaagccatgtttgtagaatatagaaaacaactgaagttactgttggacaggcttgctcaagtttcaccagagttactactggcctctgttcgcagagtttttagttctacactgcagaattggcagactacacggtttatggaagttgaagtagcaataagattgctgtatatgttggcagaagctcttccagtatctcatggtgctcacttctcaggtgatgtttcaaaagctagtgctttgcaggatatgatgcgaactctggtaacatcaggagtcagttcctatcagcatacatctgtgacattggagttcttcgaaactgttgttagatatgaaaagtttttcacagttgaacctcagcacattccatgtgtactaatggctttcttagatcacagaggtctgcggcattccagtgcaaaagttcggagcaggacggcttacctgttttctagatttgtcaaatctctcaataagcaaatgaatcctttcattgaggatattttgaatagaatacaagatttattagagctttctccacctgagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggccaaattcaagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccaattgcacagaaaacatgttttatcatcctctcaaagttggtagaactctggggaggtaaagatggaccagtgggatttgctgattttgtttataagcacattgtccccgcatgtttcctagcacctttaaaacaaacctttgacctggcagatgcacaaacagtattggctttatctgagtgtgcagtgacactgaaaacaattcatctcaaacggggcccagaatgtgttcagtatcttcaacaagaatacctgccctccttgcaagtagctccagaaataattcaggagcctaataggcttttccagactgctgaaggggaccacagca

SEQ ID NO: 3655 - DNA, 592 bp, synthetic construct; identical to SEQ ID NO: 1986
  misc_feature 1..592: note = Synthetic polypeptide
  source 1..592: mol_type = other DNA

SEQ ID NO: 3656 - DNA, 980 bp, synthetic construct; identical to SEQ ID NO: 139
  misc_feature 1..980: note = Synthetic polypeptide
  source 1..980: mol_type = other DNA

SEQ ID NO: 3657 - DNA, 1256 bp, synthetic construct; identical to SEQ ID NO: 140
  misc_feature 1..1256: note = Synthetic polypeptide
  source 1..1256: mol_type = other DNA

SEQ ID NO: 3658 - DNA, 1277 bp, synthetic construct; identical to SEQ ID NO: 142
  misc_feature 1..1277: note = Synthetic polypeptide
  source 1..1277: mol_type = other DNA

SEQ ID NO: 3659 - DNA, 55 bp, synthetic construct; identical to SEQ ID NO: 291
  misc_feature 1..55: note = Synthetic polypeptide
  source 1..55: mol_type = other DNA

SEQ ID NO: 3660 - DNA, 25 bp, synthetic construct
  misc_feature 1..25: note = Synthetic polypeptide
  source 1..25: mol_type = other DNA
atgagcgtcctttcgtttttttaaa

SEQ ID NO: 3661 - DNA, 1770 bp, synthetic construct; identical to SEQ ID NO: 2055
  misc_feature 1..1770: note = Synthetic polypeptide
  source 1..1770: mol_type = other DNA

SEQ ID NO: 3662 - DNA, 1465 bp, synthetic construct; identical to SEQ ID NO: 2056
  misc_feature 1..1465: note = Synthetic polypeptide
  source 1..1465: mol_type = other DNA

SEQ ID NO: 3663 - DNA, 586 bp, synthetic construct; identical to SEQ ID NO: 401
  misc_feature 1..586: note = Synthetic polypeptide
  source 1..586: mol_type = other DNA

SEQ ID NO: 3664 - DNA, 829 bp, synthetic construct; identical to SEQ ID NO: 402
  misc_feature 1..829: note = Synthetic polypeptide
  source 1..829: mol_type = other DNA

SEQ ID NO: 3665 - DNA, 1060 bp, synthetic construct; identical to SEQ ID NO: 403
  misc_feature 1..1060: note = Synthetic polypeptide
  source 1..1060: mol_type = other DNA

SEQ ID NO: 3666 - DNA, 730 bp, synthetic construct; identical to SEQ ID NO: 406
  misc_feature 1..730: note = Synthetic polypeptide
  source 1..730: mol_type = other DNA

SEQ ID NO: 3667 - DNA, 496 bp, synthetic construct; identical to SEQ ID NO: 408
  misc_feature 1..496: note = Synthetic polypeptide
  source 1..496: mol_type = other DNA

SEQ ID NO: 3668 - DNA, 568 bp, synthetic construct; identical to SEQ ID NO: 1967
  misc_feature 1..568: note = Synthetic polypeptide
  source 1..568: mol_type = other DNA

SEQ ID NO: 3669 - DNA, 379 bp, synthetic construct; identical to SEQ ID NO: 1968
  misc_feature 1..379: note = Synthetic polypeptide
  source 1..379: mol_type = other DNA

SEQ ID NO: 3670 - DNA, 1834 bp, synthetic construct; identical to SEQ ID NO: 133
  misc_feature 1..1834: note = Synthetic polypeptide
  source 1..1834: mol_type = other DNA

SEQ ID NO: 3671 - DNA, 1765 bp, synthetic construct; identical to SEQ ID NO: 135
  misc_feature 1..1765: note = Synthetic polypeptide
  source 1..1765: mol_type = other DNA

SEQ ID NO: 3672 - DNA, 2154 bp, synthetic construct; identical to SEQ ID NO: 1502
  misc_feature 1..2154: note = Synthetic polypeptide
  source 1..2154: mol_type = other DNA

SEQ ID NO: 3673 - DNA, 2025 bp, synthetic construct; identical to SEQ ID NO: 1503
  misc_feature 1..2025: note = Synthetic polypeptide
  source 1..2025: mol_type = other DNA

SEQ ID NO: 3674 - DNA, 890 bp, synthetic construct; identical to SEQ ID NO: 319
  misc_feature 1..890: note = Synthetic polypeptide
  source 1..890: mol_type = other DNA

SEQ ID NO: 3675 - DNA, 947 bp, synthetic construct; identical to SEQ ID NO: 320
  misc_feature 1..947: note = Synthetic polypeptide
  source 1..947: mol_type = other DNA

SEQ ID NO: 3676 - DNA, 652 bp, synthetic construct; identical to SEQ ID NO: 2065
  misc_feature 1..652: note = Synthetic polypeptide
  source 1..652: mol_type = other DNA

SEQ ID NO: 3677 - DNA, 533 bp, synthetic construct; identical to SEQ ID NO: 1098
  misc_feature 1..533: note = Synthetic polypeptide
  source 1..533: mol_type = other DNA

SEQ ID NO: 3678 - DNA, 102 bp, synthetic construct; identical to SEQ ID NO: 258
  misc_feature 1..102: note = Synthetic polypeptide
  source 1..102: mol_type = other DNA

SEQ ID NO: 3679 - DNA, 82 bp, synthetic construct; identical to SEQ ID NO: 257
  misc_feature 1..82: note = Synthetic polypeptide
  source 1..82: mol_type = other DNA

SEQ ID NO: 3680 - DNA, 609 bp, synthetic construct; identical to SEQ ID NO: 249
  misc_feature 1..609: note = Synthetic polypeptide
  source 1..609: mol_type = other DNA

SEQ ID NO: 3681 - DNA, 738 bp, synthetic construct; identical to SEQ ID NO: 250
  misc_feature 1..738: note = Synthetic polypeptide
  source 1..738: mol_type = other DNA

SEQ ID NO: 3682 - DNA, 537 bp, synthetic construct; identical to SEQ ID NO: 251
  misc_feature 1..537: note = Synthetic polypeptide
  source 1..537: mol_type = other DNA

SEQ ID NO: 3683 - DNA, 684 bp, synthetic construct; identical to SEQ ID NO: 253
  misc_feature 1..684: note = Synthetic polypeptide
  source 1..684: mol_type = other DNA

SEQ ID NO: 3684 - DNA, 285 bp, synthetic construct; identical to SEQ ID NO: 255
  misc_feature 1..285: note = Synthetic polypeptide
  source 1..285: mol_type = other DNA

SEQ ID NO: 3685 - DNA, 552 bp, synthetic construct; identical to SEQ ID NO: 254
  misc_feature 1..552: note = Synthetic polypeptide
  source 1..552: mol_type = other DNA

SEQ ID NO: 3686 - DNA, 266 bp, synthetic construct; identical to SEQ ID NO: 2578
  misc_feature 1..266: note = Synthetic polypeptide
  source 1..266: mol_type = other DNA

SEQ ID NO: 3687 - DNA, 3825 bp, synthetic construct; identical to SEQ ID NO: 158
  misc_feature 1..3825: note = Synthetic polypeptide
  source 1..3825: mol_type = other DNA

SEQ ID NO: 3688 - DNA, 763 bp, synthetic construct; identical to SEQ ID NO: 261
  misc_feature 1..763: note = Synthetic polypeptide
  source 1..763: mol_type = other DNA

SEQ ID NO: 3689 - DNA, 646 bp, synthetic construct; identical to SEQ ID NO: 262
  misc_feature 1..646: note = Synthetic polypeptide
  source 1..646: mol_type = other DNA

SEQ ID NO: 3690 - DNA, 677 bp, synthetic construct; identical to SEQ ID NO: 2175
  misc_feature 1..677: note = Synthetic polypeptide
  source 1..677: mol_type = other DNA

SEQ ID NO: 3691 - DNA, 3220 bp, synthetic construct; identical to SEQ ID NO: 248
  misc_feature 1..3220: note = Synthetic polypeptide
  source 1..3220: mol_type = other DNA

SEQ ID NO: 3692 - DNA, 775 bp, synthetic construct; identical to SEQ ID NO: 215
  misc_feature 1..775: note = Synthetic polypeptide
  source 1..775: mol_type = other DNA

SEQ ID NO: 3693 - DNA, 1794 bp, synthetic construct
  misc_feature 1..1794: note = Synthetic polypeptide
  source 1..1794: mol_type = other DNA
atgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcaggtataagaaaaaatgaagaagacttctatgttctattatggagtgatccctaagatacatttttaaatgagtaaagcaaagtggagagaagtgcaaatagtatattatc

SEQ ID NO: 3694 - DNA, 1845 bp, synthetic construct
  misc_feature 1..1845: note = Synthetic polypeptide
  source 1..1845: mol_type = other DNA
atgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtgcagccgctgcattttttaacatgggatacctgttattttcattatttagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcaggtataagaaaaaatgaagaagacttctatgttctattatggagtgatccctaagatacatttttaaatgagtaaagcaaagtggagagaagtgcaaatagtatattatc

SEQ ID NO: 3695 - DNA, 1734 bp, synthetic construct
  misc_feature 1..1734: note = Synthetic polypeptide
  source 1..1734: mol_type = other DNA
atgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaagaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcaggtataagaaaaaatgaagaagacttctatgttctattatggagtgatccctaagatacatttttaaatgagtaaagcaaagtggagagaagtgcaaatagtatattatc

SEQ ID NO: 3696 - DNA, 1785 bp, synthetic construct
  misc_feature 1..1785: note = Synthetic polypeptide
  source 1..1785: mol_type = other DNA
atgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtgcagccgctgcattttttaacatgggatacctgttattttcattatttagtcccaacccctatgtctccctcctcgaaatcagtgagcactcccagtgaagctggaagccaagactcaggcgatctggggccattaacaagaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcaggtataagaaaaaatgaagaagacttctatgttctattatggagtgatccctaagatacatttttaaatgagtaaagcaaagtggagagaagtgcaaatagtatattatc

SEQ ID NO: 3697 - DNA, 876 bp, synthetic construct
  misc_feature 1..876: note = Synthetic polypeptide
  source 1..876: mol_type = other DNA
atgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacaggcacatggatgaagctggaagccatcatcctcagcaaactaacacagaaacagaaaaccaaacaccgtgtgttcttccaacaagaatttatgaacacagggaggggaacaacacacaccagggccagtcgggagggtggagggcaagggaagggagtgcattgggacaaatcgctaatgcatgtggggcttaaaacctagatgacaggttaataggtgccgcaaactaccatggcgtacatatacctatgtaacaaacctacacgttctgcacttgtattccgaaacttaaagtaaaataaataaa

SEQ ID NO: 3698 - DNA, 786 bp, synthetic construct
  misc_feature 1..786: note = Synthetic polypeptide
  source 1..786: mol_type = other DNA
atgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacaggcacatggatgaagctggaagccatcatcctcagcaaactaacacagaaacagaaaaccaaacaccgtgtgttcttccaacaagaatttatgaacacagggaggggaacaacacacaccagggccagtcgggagggtggagggcaagggaagggagtgcattgggacaaatcgctaatgcatgtggggcttaaaacctagatgacaggttaataggtgccgcaaactaccatggcgtacatatacctatgtaacaaacctacacgttctgcacttgtattccgaaacttaaagtaaaataaataaa

SEQ ID NO: 3699 - DNA, 594 bp, synthetic construct
  misc_feature 1..594: note = Synthetic polypeptide
  source 1..594: mol_type = other DNA
agtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacaggcacatggatgaagctggaagccatcatcctcagcaaactaacacagaaacagaaaaccaaacaccgtgtgttcttccaacaagaatttatgaacacagggaggggaacaacacacaccagggccagtcgggagggtggagggcaagggaagggagtgcattgggacaaatcgctaatgcatgtggggcttaaaacctagatgacaggttaataggtgccgcaaactaccatggcgtacatatacctatgtaacaaacctacacgttctgcacttgtattccgaaacttaaagtaaaataaataaa

SEQ ID NO: 3700 - DNA, 816 bp, synthetic construct
  misc_feature 1..816: note = Synthetic polypeptide
  source 1..816: mol_type = other DNA
atgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcaggcacttggaggtgtcccaggaagtcagccattactccccagtggaatggatccaactcgacaacaaggacatccaaatatgggtgggccaatgcagagaatgactcctccaagaggaatggtgcccttaggaccacaggcacatggatgaagctggaagccatcatcctcagcaaactaacacagaaacagaaaaccaaacaccgtgtgttcttccaacaagaatttatgaacacagggaggggaacaacacacaccagggccagtcgggagggtggagggcaagggaagggagtgcattgggacaaatcgctaatgcatgtggggcttaaaacctagatgacaggttaataggtgccgcaaactaccatggcgtacatatacctatgtaacaaacctacacgttctgcacttgtattccgaaacttaaagtaaaataaataaa

SEQ ID NO: 3701 - DNA, 864 bp, synthetic construct
  misc_feature 1..864: note = Synthetic polypeptide
  source 1..864: mol_type = other DNA
atgcttgtgatcccctcagccctcatgtattcattcgtattatattggaggttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacaggcacatggatgaagctggaagccatcatcctcagcaaactaacacagaaacagaaaaccaaacaccgtgtgttcttccaacaagaatttatgaacacagggaggggaacaacacacaccagggccagtcgggagggtggagggcaagggaagggagtgcattgggacaaatcgctaatgcatgtggggcttaaaacctagatgacaggttaataggtgccgcaaactaccatggcgtacatatacctatgtaacaaacctacacgttctgcacttgtattccgaaacttaaagtaaaataaataaa

SEQ ID NO: 3702 - DNA, 573 bp, synthetic construct; identical to SEQ ID NO: 1369
  misc_feature 1..573: note = Synthetic polypeptide
  source 1..573: mol_type = other DNA

SEQ ID NO: 3703 - DNA, 416 bp, synthetic construct; identical to SEQ ID NO: 1370
  misc_feature 1..416: note = Synthetic polypeptide
  source 1..416: mol_type = other DNA

SEQ ID NO: 3704 - DNA, 500 bp, synthetic construct; identical to SEQ ID NO: 204
  misc_feature 1..500: note = Synthetic polypeptide
  source 1..500: mol_type = other DNA

SEQ ID NO: 3705 - DNA, 656 bp, synthetic construct; identical to SEQ ID NO: 205
  misc_feature 1..656: note = Synthetic polypeptide
  source 1..656: mol_type = other DNA

SEQ ID NO: 3706 - DNA, 524 bp, synthetic construct; identical to SEQ ID NO: 207
  misc_feature 1..524: note = Synthetic polypeptide
  source 1..524: mol_type = other DNA

SEQ ID NO: 3707 - DNA, 3881 bp, synthetic construct; identical to SEQ ID NO: 1162
  misc_feature 1..3881: note = Synthetic polypeptide
  source 1..3881: mol_type = other DNA

SEQ ID NO: 3708 - DNA, 3722 bp, synthetic construct; identical to SEQ ID NO: 1163
  misc_feature 1..3722: note = Synthetic polypeptide
  source 1..3722: mol_type = other DNA

SEQ ID NO: 3709 - DNA, 118 bp, synthetic construct; identical to SEQ ID NO: 162
  misc_feature 1..118: note = Synthetic polypeptide
  source 1..118: mol_type = other DNA

SEQ ID NO: 3710 - DNA, 434 bp, synthetic construct
  misc_feature 1..434: note = Synthetic polypeptide
  source 1..434: mol_type = other DNA
atgtccgcccagaggttaatttctaacagaacctcccagcaatcggcatctaattctgattacacctgggaatatgaatattatgagattggaccagtttcctttgaaggactgaaggctcataaatattccattgtgattggattttgggttggtcttgcagtcttcgtgatttttatgttttttgtgctgaccttgctgaccaagacaggagccccacaccaagaattaccctccatgctgtgagtgggcctcatccagtcagttgaaggccttaagagaacaaagactgacctcctcaagccaaaagggattctaccaggacactgcctttggactgtctccaccctgccagcctactctacatatttgggacttgctggtccccaaagttacatgaggcaattccttaaaataaaactctctctttataa

SEQ ID NO: 3711 - DNA, 4277 bp, synthetic construct; identical to SEQ ID NO: 2069
  misc_feature 1..4277: note = Synthetic polypeptide
  source 1..4277: mol_type = other DNA

SEQ ID NO: 3712 - DNA, 809 bp, synthetic construct; identical to SEQ ID NO: 2110
  misc_feature 1..809: note = Synthetic polypeptide
  source 1..809: mol_type = other DNA

SEQ ID NO: 3713 - DNA, 644 bp, synthetic construct; identical to SEQ ID NO: 2111
  misc_feature 1..644: note = Synthetic polypeptide
  source 1..644: mol_type = other DNA

SEQ ID NO: 3714 - DNA, 768 bp, synthetic construct; identical to SEQ ID NO: 2112
  misc_feature 1..768: note = Synthetic polypeptide
  source 1..768: mol_type = other DNA

SEQ ID NO: 3715 - DNA, 427 bp, synthetic construct; identical to SEQ ID NO: 2113
  misc_feature 1..427: note = Synthetic polypeptide
  source 1..427: mol_type = other DNA

SEQ ID NO: 3716 - DNA, 965 bp, synthetic construct; identical to SEQ ID NO: 1615
  misc_feature 1..965: note = Synthetic polypeptide
  source 1..965: mol_type = other DNA

SEQ ID NO: 3717 - DNA, 1452 bp, synthetic construct
  misc_feature 1..1452: note = Synthetic polypeptide
  source 1..1452: mol_type = other DNA
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaaagacttggaatgaacccaaatgtccatcaatgatagactggattaagaaaatgtggcacatatacaccatagaatactatgcagtcataaaaaaggatgagttcatgtcctttgtaggaacatggatgaagctggaaaccatcattctgagcaaactatcacaaggacagaaaaccaaacgccgcatgttctcattcacaggtgggaactgaacaatgagaacacttggacacagggcggggaacatcacacaccagggcctgtcggggggtaggggtagggaggcgggatggcattaacagaaatacctattgtaaatgacgagttaatgggtgcagcacaccaacatggcacatgtatacatatgtaacaaacctgcactttgtgcacatgtaccctagaacttaaagtaaaatttaaaaaaaagagaa

SEQ ID NO: 3718 - DNA, 1155 bp, synthetic construct
  misc_feature 1..1155: note = Synthetic polypeptide
  source 1..1155: mol_type = other DNA
atggaatgtctctactatttcctgggatttctgctcctggctgcaagattgccacttgatgccgccaaacaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaaagacttggaatgaacccaaatgtccatcaatgatagactggattaagaaaatgtggcacatatacaccatagaatactatgcagtcataaaaaaggatgagttcatgtcctttgtaggaacatggatgaagctggaaaccatcattctgagcaaactatcacaaggacagaaaaccaaacgccgcatgttctcattcacaggtgggaactgaacaatgagaacacttggacacagggcggggaacatcacacaccagggcctgtcggggggtaggggtagggaggcgggatggcattaacagaaatacctattgtaaatgacgagttaatgggtgcagcacaccaacatggcacatgtatacatatgtaacaaacctgcactttgtgcacatgtaccctagaacttaaagtaaaatttaaaaaaaagagaa

SEQ ID NO: 3719 - DNA, 1278 bp, synthetic construct
  misc_feature 1..1278: note = Synthetic polypeptide
  source 1..1278: mol_type = other DNA
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaaagacttggaatgaacccaaatgtccatcaatgatagactggattaagaaaatgtggcacatatacaccatagaatactatgcagtcataaaaaaggatgagttcatgtcctttgtaggaacatggatgaagctggaaaccatcattctgagcaaactatcacaaggacagaaaaccaaacgccgcatgttctcattcacaggtgggaactgaacaatgagaacacttggacacagggcggggaacatcacacaccagggcctgtcggggggtaggggtagggaggcgggatggcattaacagaaatacctattgtaaatgacgagttaatgggtgcagcacaccaacatggcacatgtatacatatgtaacaaacctgcactttgtgcacatgtaccctagaacttaaagtaaaatttaaaaaaaagagaa

SEQ ID NO: 3720 - DNA, 1052 bp, synthetic construct; identical to SEQ ID NO: 247
  misc_feature 1..1052: note = Synthetic polypeptide
  source 1..1052: mol_type = other DNA

SEQ ID NO: 3721 - DNA, 327 bp, synthetic construct; identical to SEQ ID NO: 246
  misc_feature 1..327: note = Synthetic polypeptide
  source 1..327: mol_type = other DNA

SEQ ID NO: 3722 - DNA, 2713 bp, synthetic construct; identical to SEQ ID NO: 1273
  misc_feature 1..2713: note = Synthetic polypeptide
  source 1..2713: mol_type = other DNA

SEQ ID NO: 3723 - DNA, 228 bp, synthetic construct; identical to SEQ ID NO: 1274
  misc_feature 1..228: note = Synthetic polypeptide
  source 1..228: mol_type = other DNA

SEQ ID NO: 3724 - DNA, 2567 bp, synthetic construct; identical to SEQ ID NO: 1766
  misc_feature 1..2567: note = Synthetic polypeptide
  source 1..2567: mol_type = other DNA

SEQ ID NO: 3725 - DNA, 572 bp, synthetic construct; identical to SEQ ID NO: 1767
  misc_feature 1..572: note = Synthetic polypeptide
  source 1..572: mol_type = other DNA

SEQ ID NO: 3726 - DNA, 1049 bp, synthetic construct; identical to SEQ ID NO: 224
  misc_feature 1..1049: note = Synthetic polypeptide
  source 1..1049: mol_type = other DNA

SEQ ID NO: 3727 - DNA, 3628 bp, synthetic construct; identical to SEQ ID NO: 330
  misc_feature 1..3628: note = Synthetic polypeptide
  source 1..3628: mol_type = other DNA

SEQ ID NO: 3728 - DNA, 3127 bp, synthetic construct; identical to SEQ ID NO: 332
  misc_feature 1..3127: note = Synthetic polypeptide
  source 1..3127: mol_type = other DNA

SEQ ID NO: 3729 - DNA, 103 bp, synthetic construct; identical to SEQ ID NO: 173
  misc_feature 1..103: note = Synthetic polypeptide
  source 1..103: mol_type = other DNA

SEQ ID NO: 3730 - DNA, 2648 bp, synthetic construct
  misc_feature 1..2648: note = Synthetic polypeptide
  source 1..2648: mol_type = other DNA
atggaggtgacctgccttctacttctggcgctgatccccttccactgccggggacaaggagtctacgctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgacatctatgagcccctctacactcagggggagaccaaggtcctgaagctgaagaacctgcggccccaggactatgccagctacacctgccaggtgtctgtgcgtaacgtgtgcggcatcccagacaaggccatcaccttccggctcaccaacaccacggcaccaccagccctgaagctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagtccccatgcttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagctcctggctctgaggaccctgtcctctgacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggtggtgaaggttgcagtgagctgagattgtaccattgcactccatcctgggcagcaagagcaaaactccatttcaaaaaaaaaaaaggaaaaagaaaaga

SEQ ID NO: 3731 - DNA, 2636 bp, synthetic construct
  misc_feature 1..2636: note = Synthetic polypeptide
  source 1..2636: mol_type = other DNA
atggaggtgacctgccttctacttctggcgctgatccccttccactgccggggacaaggagtctacgctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgacatctatgagcccctctacactcagggggagaccaaggtcctgaagctgaagaacctgcggccccaggactatgccagctacacctgccaggtgtctgtgcgtaacgtgtgcggcatcccagacaaggccatcaccttccggctcaccaacaccacggcaccaccagccctgaagctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcccatcaactctccgaacctttcagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggtggtgaaggttgcagtgagctgagattgtaccattgcactccatcctgggcagcaagagcaaaactccatttcaaaaaaaaaaaaggaaaaagaaaaga

SEQ ID NO: 3732 - DNA, 565 bp, synthetic construct
  misc_feature 1..565: note = Synthetic polypeptide
  source 1..565: mol_type = other DNA
tgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggtggtgaaggttgcagtgagctgagattgtaccattgcactccatcctgggcagcaagagcaaaactccatttcaaaaaaaaaaaaggaaaaagaaaaga

SEQ ID NO: 3733 - DNA, 1394 bp, synthetic construct; identical to SEQ ID NO: 1118
  misc_feature 1..1394: note = Synthetic polypeptide
  source 1..1394: mol_type = other DNA

SEQ ID NO: 3734 - DNA, 1625 bp, synthetic construct; identical to SEQ ID NO: 1119
  misc_feature 1..1625: note = Synthetic polypeptide
  source 1..1625: mol_type = other DNA

SEQ ID NO: 3735 - DNA, 1505 bp, synthetic construct; identical to SEQ ID NO: 1120
  misc_feature 1..1505: note = Synthetic polypeptide
  source 1..1505: mol_type = other DNA

SEQ ID NO: 3736 - DNA, 1562 bp, synthetic construct; identical to SEQ ID NO: 1121
  misc_feature 1..1562: note = Synthetic polypeptide
  source 1..1562: mol_type = other DNA

SEQ ID NO: 3737 - DNA, 1601 bp, synthetic construct; identical to SEQ ID NO: 1122
  misc_feature 1..1601: note = Synthetic polypeptide
  source 1..1601: mol_type = other DNA

SEQ ID NO: 3738 - DNA, 1631 bp, synthetic construct; identical to SEQ ID NO: 1123
  misc_feature 1..1631: note = Synthetic polypeptide
  source 1..1631: mol_type = other DNA

SEQ ID NO: 3739 - DNA, 2370 bp, synthetic construct; identical to SEQ ID NO: 210
  misc_feature 1..2370: note = Synthetic polypeptide
  source 1..2370: mol_type = other DNA

SEQ ID NO: 3740 - DNA, 2259 bp, synthetic construct; identical to SEQ ID NO: 212
  misc_feature 1..2259: note = Synthetic polypeptide
  source 1..2259: mol_type = other DNA

SEQ ID NO: 3741 - DNA, 1692 bp, synthetic construct; identical to SEQ ID NO: 1048
  misc_feature 1..1692: note = Synthetic polypeptide
  source 1..1692: mol_type = other DNA

SEQ ID NO: 3742 - DNA, 1695 bp, synthetic construct; identical to SEQ ID NO: 1049
  misc_feature 1..1695: note = Synthetic polypeptide
  source 1..1695: mol_type = other DNA

SEQ ID NO: 3743 - DNA, 466 bp, synthetic construct; identical to SEQ ID NO: 1050
  misc_feature 1..466: note = Synthetic polypeptide
  source 1..466: mol_type = other DNA

SEQ ID NO: 3744 - DNA, 872 bp, synthetic construct
  misc_feature 1..872: note = Synthetic polypeptide
  source 1..872: mol_type = other DNA
atggcaggtgggggcagcgacctgagcaccagggggctgaacggaggtgtttcacaagtagcaaatgagatgaaccatcttcctgcacacagccaaagtctgcaaaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagctttgaagatggaagagggaaccaaggaatgtggatgacctctagaagctgaaaaaacaaggaaatagtttgtcctttccagcccccagaaaggaatgaaggcctacaccttgactttaggcagtaagacccgtgtcacacttctcactgacataactggaagataatatatttgtgttgttttaaaccactaaatttgtggtaatttgttatggcagcaattaagagtaatac

SEQ ID NO: 3745 - DNA, 611 bp, synthetic construct
  misc_feature 1..611: note = Synthetic polypeptide
  source 1..611: mol_type = other DNA
atgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagctttgaagatggaagagggaaccaaggaatgtggatgacctctagaagctgaaaaaacaaggaaatagtttgtcctttccagcccccagaaaggaatgaaggcctacaccttgactttaggcagtaagacccgtgtcacacttctcactgacataactggaagataatatatttgtgttgttttaaaccactaaatttgtggtaatttgttatggcagcaattaagagtaatac

SEQ ID NO: 3746 - DNA, 559 bp, synthetic construct; identical to SEQ ID NO: 1701
  misc_feature 1..559: note = Synthetic polypeptide
  source 1..559: mol_type = other DNA

SEQ ID NO: 3747 - DNA, 639 bp, synthetic construct; identical to SEQ ID NO: 1176
  misc_feature 1..639: note = Synthetic polypeptide
  source 1..639: mol_type = other DNA

SEQ ID NO: 3748 - DNA, 316 bp, synthetic construct; identical to SEQ ID NO: 2265
  misc_feature 1..316: note = Synthetic polypeptide
  source 1..316: mol_type = other DNA

SEQ ID NO: 3749 - DNA, 299 bp, synthetic construct; identical to SEQ ID NO: 1033
  misc_feature 1..299: note = Synthetic polypeptide
  source 1..299: mol_type = other DNA

SEQ ID NO: 3750 - DNA, 191 bp, synthetic construct; identical to SEQ ID NO: 1034
  misc_feature 1..191: note = Synthetic polypeptide
  source 1..191: mol_type = other DNA

SEQ ID NO: 3751 - DNA, 832 bp, synthetic construct
  misc_feature 1..832: note = Synthetic polypeptide
  source 1..832: mol_type = other DNA
atggctctacccaaagacgccatcccctcgctgtccgagtgccagtgcgggatctgcatggaaatcctcgtggagcccgtcaccctcccgtgtaaccacacgctgtgtaaaccgtgcttccagtcgaccgtcgaaaaggcgagtttatgctgtcccttctgtcgccgccgggtatcgtcgtggactcggtaccatacccgaagaaattctctcgtcaacgtggaactgtggacgataattcaaaaacactatcccagggagtgcaagcttagagcgtctggccaagaatcagaggaagtggctgatgactatcagccagttcgtctgctcagtaaacctggggaactgagaagagaatatgaagaggaaataagcaaggtggcggcagagcgacgggccagcgaggaagaagaaaacaaagccagtgaagaatacatacagaggttgttggcagaggaggaagaagaggaaaaaagacaggcagaaaaaaggcgaagagcgatggaagaacaactgaaaagtgatgaggaactggcaagaaagctaagcattgatattggtgcgatggctcgggcctgtaatcccagtacattgggaagctgaggcgagaggatcgcttgagcccaggagtttgagaccagcctgggcaacaaagtgagaccctgtttcttcagaaaaattaataatgagccgagtgtgatggtgcgtgcctggagctccacctgctgggaggggctgaggcaggaggatcccttgagcccaggagtttgaggttacagtgagctgatctcgccactgcacttcaacctggaagaccatctcaaaaaaaaaa

SEQ ID NO: 3752 - DNA, 819 bp, synthetic construct; identical to SEQ ID NO: 333
  misc_feature 1..819: note = Synthetic polypeptide
  source 1..819: mol_type = other DNA

SEQ ID NO: 3753 - DNA, 876 bp, synthetic construct; identical to SEQ ID NO: 334
  misc_feature 1..876: note = Synthetic polypeptide
  source 1..876: mol_type = other DNA

SEQ ID NO: 3754 - DNA, 4591 bp, synthetic construct; identical to SEQ ID NO: 2478
  misc_feature 1..4591: note = Synthetic polypeptide
  source 1..4591: mol_type = other DNA

SEQ ID NO: 3755 - DNA, 4261 bp, synthetic construct; identical to SEQ ID NO: 2479
  misc_feature 1..4261: note = Synthetic polypeptide
  source 1..4261: mol_type = other DNA

SEQ ID NO: 3756 - DNA, 506 bp, synthetic construct; identical to SEQ ID NO: 1096
  misc_feature 1..506: note = Synthetic polypeptide
  source 1..506: mol_type = other DNA

SEQ ID NO: 3757 - DNA, 348 bp, synthetic construct
  misc_feature 1..348: note = Synthetic polypeptide
  source 1..348: mol_type = other DNA
atggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttggaatatttgacaacgtctggagacagtgtctggcttgtcacagttggggaagataccacagatatctcgtgggtagaagccggggtgcagttaaatatcctatgaagcatataatgctgttctctacaacaaagaattgtctgacgttgctgaagttaagaaactctg

SEQ ID NO: 3758 - DNA, 1823 bp, synthetic construct; identical to SEQ ID NO: 2096
  misc_feature 1..1823: note = Synthetic polypeptide
  source 1..1823: mol_type = other DNA

SEQ ID NO: 3759 - DNA, 1859 bp, synthetic construct; identical to SEQ ID NO: 2097
  misc_feature 1..1859: note = Synthetic polypeptide
  source 1..1859: mol_type = other DNA

SEQ ID NO: 3760 - DNA, 1526 bp, synthetic construct; identical to SEQ ID NO: 2098
  misc_feature 1..1526: note = Synthetic polypeptide
  source 1..1526: mol_type = other DNA

SEQ ID NO: 3761 - DNA, 1685 bp, synthetic construct; identical to SEQ ID NO: 2099
  misc_feature 1..1685: note = Synthetic polypeptide
  source 1..1685: mol_type = other DNA

SEQ ID NO: 3762 - DNA, 1391 bp, synthetic construct; identical to SEQ ID NO: 1200
  misc_feature 1..1391: note = Synthetic polypeptide
  source 1..1391: mol_type = other DNA

SEQ ID NO: 3763 - DNA, 467 bp, synthetic construct; identical to SEQ ID NO: 1201
  misc_feature 1..467: note = Synthetic polypeptide
  source 1..467: mol_type = other DNA

SEQ ID NO: 3764 - DNA, 641 bp, synthetic construct; identical to SEQ ID NO: 1202
  misc_feature 1..641: note = Synthetic polypeptide
  source 1..641: mol_type = other DNA

SEQ ID NO: 3765 - DNA, 377 bp, synthetic construct; identical to SEQ ID NO: 299
  misc_feature 1..377: note = Synthetic polypeptide
  source 1..377: mol_type = other DNA

SEQ ID NO: 3766 - DNA, 377 bp, synthetic construct; identical to SEQ ID NO: 300
  misc_feature 1..377: note = Synthetic polypeptide
  source 1..377: mol_type = other DNA

SEQ ID NO: 3767 - DNA, 698 bp, synthetic construct
  misc_feature 1..698: note = Synthetic polypeptide
  source 1..698: mol_type = other DNA
atgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtgggcaccccctttgccttctgccgtgactggaggcttcctgaggccttactagaagctgagcagatgctgttaccatacttcccgtacagcctgcagaaccgtgagccaattaaacctcttttctttataaattacgcagcctcaggtattcctttatagcagtgcataaaatggccta

SEQ ID NO: 3768 - DNA, 488 bp, synthetic construct
  misc_feature 1..488: note = Synthetic polypeptide
  source 1..488: mol_type = other DNA
atgttgtcccgaaggtacgaaggcgaaatacccaaaaatatttgcaagaggaagaaaacagtccaccaagtgacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtgggcaccccctttgccttctgccgtgactggaggcttcctgaggccttactagaagctgagcagatgctgttaccatacttcccgtacagcctgcagaaccgtgagccaattaaacctcttttctttataaattacgcagcctcaggtattcctttatagcagtgcataaaatggccta

SEQ ID NO: 3769 - DNA, 1416 bp, synthetic construct; identical to SEQ ID NO: 226
  misc_feature 1..1416: note = Synthetic polypeptide
  source 1..1416: mol_type = other DNA

SEQ ID NO: 3770 - DNA, 3995 bp, synthetic construct; identical to SEQ ID NO: 2035
  misc_feature 1..3995: note = Synthetic polypeptide
  source 1..3995: mol_type = other DNA

SEQ ID NO: 3771 - DNA, 3836 bp, synthetic construct; identical to SEQ ID NO: 2036
  misc_feature 1..3836: note = Synthetic polypeptide
  source 1..3836: mol_type = other DNA

SEQ ID NO: 3772 - DNA, 732 bp, synthetic construct; identical to SEQ ID NO: 2476
  misc_feature 1..732: note = Synthetic polypeptide
  source 1..732: mol_type = other DNA

SEQ ID NO: 3773 - DNA, 2161 bp, synthetic construct; identical to SEQ ID NO: 288
  misc_feature 1..2161: note = Synthetic polypeptide
  source 1..2161: mol_type = other DNA

SEQ ID NO: 3774 - DNA, 2140 bp, synthetic construct; identical to SEQ ID NO: 289
  misc_feature 1..2140: note = Synthetic polypeptide
  source 1..2140: mol_type = other DNA

SEQ ID NO: 3775 - DNA, 529 bp, synthetic construct; identical to SEQ ID NO: 287
  misc_feature 1..529: note = Synthetic polypeptide
  source 1..529: mol_type = other DNA

SEQ ID NO: 3776 - DNA, 542 bp, synthetic construct
  misc_feature 1..542: note = Synthetic polypeptide
  source 1..542: mol_type = other DNA
atgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaagggacatggatggagttggaagccgttatcctcagcaaaccaacacaggaacagaagaccaaacaccgcatgttctcacttataagtgggagctgaatgatgagaacacagggacaaaagggggtgaggaaacaacagacactggggccttttggattaggggtgttgcgggagggagagcatcaggaagaacagctgatagatgctgggcttaatatctaggtgatgggatgatctgtgcagcaaaccaccatggtacatgttgacctatgtaacaaacctggacatcctgcacatgtactcctgaacttaaaagatgaagaaaaaaa

SEQ ID NO: 3777 - DNA, 1035 bp, synthetic construct; identical to SEQ ID NO: 1131
  misc_feature 1..1035: note = Synthetic polypeptide
  source 1..1035: mol_type = other DNA

SEQ ID NO: 3778 - DNA, 996 bp, synthetic construct; identical to SEQ ID NO: 1132
  misc_feature 1..996: note = Synthetic polypeptide
  source 1..996: mol_type = other DNA

SEQ ID NO: 3779 - DNA, 1047 bp, synthetic construct; identical to SEQ ID NO: 1133
  misc_feature 1..1047: note = Synthetic polypeptide
  source 1..1047: mol_type = other DNA

SEQ ID NO: 3780 - DNA, 1137 bp, synthetic construct; identical to SEQ ID NO: 1134
  misc_feature 1..1137: note = Synthetic polypeptide
  source 1..1137: mol_type = other DNA

SEQ ID NO: 3781 - DNA, 1005 bp, synthetic construct; identical to SEQ ID NO: 1135
  misc_feature 1..1005: note = Synthetic polypeptide
  source 1..1005: mol_type = other DNA

SEQ ID NO: 3782 - DNA, 1140 bp, synthetic construct; identical to SEQ ID NO: 1136
  misc_feature 1..1140: note = Synthetic polypeptide
  source 1..1140: mol_type = other DNA

SEQ ID NO: 3783 - DNA, 1128 bp, synthetic construct; identical to SEQ ID NO: 1137
  misc_feature 1..1128: note = Synthetic polypeptide
  source 1..1128: mol_type = other DNA

SEQ ID NO: 3784 - DNA, 1125 bp, synthetic construct; identical to SEQ ID NO: 1138
  misc_feature 1..1125: note = Synthetic polypeptide
  source 1..1125: mol_type = other DNA

SEQ ID NO: 3785 - DNA, 1008 bp, synthetic construct; identical to SEQ ID NO: 1139
  misc_feature 1..1008: note = Synthetic polypeptide
  source 1..1008: mol_type = other DNA

SEQ ID NO: 3786 - DNA, 943 bp, synthetic construct; identical to SEQ ID NO: 1140
  misc_feature 1..943: note = Synthetic polypeptide
  source 1..943: mol_type = other DNA

SEQ ID NO: 3787 - DNA, 660 bp, synthetic construct; identical to SEQ ID NO: 1141
  misc_feature 1..660: note = Synthetic polypeptide
  source 1..660: mol_type = other DNA

SEQ ID NO: 3788 - DNA, 593 bp, synthetic construct; identical to SEQ ID NO: 1142
  misc_feature 1..593: note = Synthetic polypeptide
  source 1..593: mol_type = other DNA

SEQ ID NO: 3789 - DNA, 571 bp, synthetic construct; identical to SEQ ID NO: 2551
  misc_feature 1..571: note = Synthetic polypeptide
  source 1..571: mol_type = other DNA

SEQ ID NO: 3790 - DNA, 3093 bp, synthetic construct; identical to SEQ ID NO: 341
  misc_feature 1..3093: note = Synthetic polypeptide
  source 1..3093: mol_type = other DNA

SEQ ID NO: 3791 - DNA, 2979 bp, synthetic construct; identical to SEQ ID NO: 342
  misc_feature 1..2979: note = Synthetic polypeptide
  source 1..2979: mol_type = other DNA

SEQ ID NO: 3792 - DNA, 3078 bp, synthetic construct; identical to SEQ ID NO: 343
  misc_feature 1..3078: note = Synthetic polypeptide
  source 1..3078: mol_type = other DNA

SEQ ID NO: 3793 - DNA, 3072 bp, synthetic construct; identical to SEQ ID NO: 346
  misc_feature 1..3072: note = Synthetic polypeptide
  source 1..3072: mol_type = other DNA

SEQ ID NO: 3794 - DNA, 1935 bp, synthetic construct; identical to SEQ ID NO: 347
  misc_feature 1..1935: note = Synthetic polypeptide
  source 1..1935: mol_type = other DNA

SEQ ID NO: 3795 - DNA, 1096 bp, synthetic construct; identical to SEQ ID NO: 348
  misc_feature 1..1096: note = Synthetic polypeptide
  source 1..1096: mol_type = other DNA

SEQ ID NO: 3796 - DNA, 902 bp, synthetic construct; identical to SEQ ID NO: 349
  misc_feature 1..902: note = Synthetic polypeptide
  source 1..902: mol_type = other DNA

SEQ ID NO: 3797 - DNA, 874 bp, synthetic construct; identical to SEQ ID NO: 350
  misc_feature 1..874: note = Synthetic polypeptide
  source 1..874: mol_type = other DNA

SEQ ID NO: 3798 - DNA, 1563 bp, synthetic construct
  misc_feature 1..1563: note = Synthetic polypeptide
  source 1..1563: mol_type = other DNA
atggcgggaagcgagccgcgcagcggaacaaactcgccgccgccgcccttcagcgactggggccgcctggaggcggccatcctcagcggctggaagaccttctggcagtcagtgagcaaggagagggtggcgcgtacgacctcacgggaggaggtggatgaggcggccagcaccctgacgcggctgccgattgatgtacagctatatattttgtcctttctttcacctcatgatctgtgtcagttgggaagtacaaatcattattggaatgaaactgtaagagatccaattctgtggagatactttttgttgagggatcttccttcttggtcttctgttgactggaagtctcttccagatctagaaatcttaaaaaagcctatatctgaggtcactgatggtgcattttttgactacatggcagtctatagaatgtgctgtccatacacaagaagagcttcaaaatccagccgtcctatgtatggagctgtcacttcttttttacactccctgatcattcagaatgaaccacgatttgctatgtttggaccaggtttggaagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaaggcagaattcagcagtcatgctggaacactgagaaagcctgcagcactgaggctctggtgcacagggcctacctaaggcctgaggctggaatgagaaaactgagaaatctccatgtccctaccaattaaggagcaacagcagactactgcagggatgggggaagggtgtggagaggctctccttgcctcttccccataacccccatggcacagttaacaagataggctgaaagctgagaacaagtagaaactctgagaaagaaactctggtactccagtgctgttactgagaacaagataggcagcagcatgctgctggaagaatttaaagtctgtgtgttacaaagttaactatagcaataaaagccaaatccagctcaactacagactagtttgattcagcctactgcattaataccctgaccgaagtatgatgcctgtttttaggagtaaatcctttttacctcagtctttattgctcttctacataaaacacctaacattaaatctaaaaattatgagacactcacaaaatcaaaatgaaatgatacattgtcatgagataaggcagtcagttgaactggaccagagatggtcagcatgttggtattctcagaaagggacattaaaataactgattaagagatctaggtcaggtacagtgg

SEQ ID NO: 3799 - DNA, 1640 bp, synthetic construct; identical to SEQ ID NO: 2480
  misc_feature 1..1640: note = Synthetic polypeptide
  source 1..1640: mol_type = other DNA

SEQ ID NO: 3800 - DNA, 1435 bp, synthetic construct; identical to SEQ ID NO: 2481
  misc_feature 1..1435: note = Synthetic polypeptide
  source 1..1435: mol_type = other DNA

SEQ ID NO: 3801 - DNA, 1628 bp, synthetic construct; identical to SEQ ID NO: 2482
  misc_feature 1..1628: note = Synthetic polypeptide
  source 1..1628: mol_type = other DNA

SEQ ID NO: 3802 - DNA, 1775 bp, synthetic construct
  misc_feature 1..1775: note = Synthetic polypeptide
  source 1..1775: mol_type = other DNA
atgccgcagctgagcctgtcctggctgggcctcgggcccgtggcagcatccccgtggctgcttctgctgctggttggaggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacattatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgctgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctggaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatt

SEQ ID NO: 3803 - DNA, 800 bp, synthetic construct
  misc_feature 1..800: note = Synthetic polypeptide
  source 1..800: mol_type = other DNA
atgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctggaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatt

SEQ ID NO: 3804 - DNA, 952 bp, synthetic construct; identical to SEQ ID NO: 1617
  misc_feature 1..952: note = Synthetic polypeptide
  source 1..952: mol_type = other DNA

SEQ ID NO: 3805 - DNA, 1046 bp, synthetic construct
  misc_feature 1..1046: note = Synthetic polypeptide
  source 1..1046: mol_type = other DNA
tagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagcctgccattacacatctttgcactggaattggtgcagatatataagtgatcctaatgttgatgctgcccagaccccaggaatgcagaggccttaagctccctggggataaggaccatgtttgtttcgctcaccactccatactcagtgtcctgcacagtacttgacacctagagaacacctggtagatgtttgt

SEQ ID NO: 3806 - DNA, 1332 bp, synthetic construct; identical to SEQ ID NO: 422
  misc_feature 1..1332: note = Synthetic polypeptide
  source 1..1332: mol_type = other DNA

SEQ ID NO: 3807 - DNA, 1254 bp, synthetic construct; identical to SEQ ID NO: 423
  misc_feature 1..1254: note = Synthetic polypeptide
  source 1..1254: mol_type = other DNA

SEQ ID NO: 3808 - DNA, 1068 bp, synthetic construct; identical to SEQ ID NO: 1221
  misc_feature 1..1068: note = Synthetic polypeptide
  source 1..1068: mol_type = other DNA

SEQ ID NO: 3809 - DNA, 1248 bp, synthetic construct; identical to SEQ ID NO: 2552
  misc_feature 1..1248: note = Synthetic polypeptide
  source 1..1248: mol_type = other DNA

SEQ ID NO: 3810 - DNA, 951 bp, synthetic construct; identical to SEQ ID NO: 2553
  misc_feature 1..951: note = Synthetic polypeptide
  source 1..951: mol_type = other DNA

SEQ ID NO: 3811 - DNA, 1074 bp, synthetic construct; identical to SEQ ID NO: 2554
  misc_feature 1..1074: note = Synthetic polypeptide
  source 1..1074: mol_type = other DNA

SEQ ID NO: 3812 - DNA, 965 bp, synthetic construct; identical to SEQ ID NO: 1035
  misc_feature 1..965: note = Synthetic polypeptide
  source 1..965: mol_type = other DNA

SEQ ID NO: 3813 - DNA, 725 bp, synthetic construct; identical to SEQ ID NO: 1036
  misc_feature 1..725: note = Synthetic polypeptide
  source 1..725: mol_type = other DNA

SEQ ID NO: 3814 - DNA, 899 bp, synthetic construct
  misc_feature 1..899: note = Synthetic polypeptide
  source 1..899: mol_type = other DNA
caagtcgcctacgtgcgcgcccgggagctgcacactcttgaagtgaccggcctggagacggttgcccagagcaaggcccatgtagcatccctggagggcctcatccctgaagataaggttgtgcttctggcaggttctcccttacagaatgaagccaccctgggtcagtgtggggtggaagccctgacaaccctggaagtggttggccgcaggctaggagtgggaaaatgaaagatggattgatagcgccgcgtgtttcaagagaagtgggagcaagcatatttctttgtggaagtatagtcctatgtgtttaatatgtaaccaaactttgtctgtgtcaaaagaatacaactgaagatgtcattatgaaacaaaccatggtgagaattttgactagtttacagaaaagatgcatgatgaaaaactcaatgaacttagaaaaggactaaactttctacagcattaatcatcgaatacaaataaaataagtgatgctgctgtgaaatgcagttacataataagtgaaaaaattgtccgtgcttcaaaatcttttacagatggtgagtttataaaagactgtctattgagtgcagcggaaatcatgtgtcctgaacagaaagaagcatttgcagacataagcctaaccagaaaaactgttgctcagagagtaaaagatatggctgagaatttacaggataagttgtgagaaaaagtgagatcatttgtgacattttctattgcagttgatgagtgcacatatgtaaataatacaagtcagttaattatgtttatccatggtgttgctgagaattttgatatcattgaagaacttttagacatggtacctatggcagatccaaccactgaaagtgacttatttttgtatgttgaaaaaagtc

SEQ ID NO: 3815 - DNA, 2361 bp, synthetic construct; identical to SEQ ID NO: 1330
  misc_feature 1..2361: note = Synthetic polypeptide
  source 1..2361: mol_type = other DNA

SEQ ID NO: 3816 - DNA, 2160 bp, synthetic construct; identical to SEQ ID NO: 1331
  misc_feature 1..2160: note = Synthetic polypeptide
  source 1..2160: mol_type = other DNA

SEQ ID NO: 3817 - DNA, 1908 bp, synthetic construct; identical to SEQ ID NO: 1332
  misc_feature 1..1908: note = Synthetic polypeptide
  source 1..1908: mol_type = other DNA

SEQ ID NO: 3818 - DNA, 2175 bp, synthetic construct; identical to SEQ ID NO: 1333
  misc_feature 1..2175: note = Synthetic polypeptide
  source 1..2175: mol_type = other DNA

SEQ ID NO: 3819 - DNA, 620 bp, synthetic construct; identical to SEQ ID NO: 2592
  misc_feature 1..620: note = Synthetic polypeptide
  source 1..620: mol_type = other DNA

SEQ ID NO: 3820 - DNA, 1292 bp, synthetic construct; identical to SEQ ID NO: 2593
  misc_feature 1..1292: note = Synthetic polypeptide
  source 1..1292: mol_type = other DNA

SEQ ID NO: 3821 - DNA, 1400 bp, synthetic construct; identical to SEQ ID NO: 2594
  misc_feature 1..1400: note = Synthetic polypeptide
  source 1..1400: mol_type = other DNA

SEQ ID NO: 3822 - DNA, 1310 bp, synthetic construct; identical to SEQ ID NO: 2595
  misc_feature 1..1310: note = Synthetic polypeptide
  source 1..1310: mol_type = other DNA

SEQ ID NO: 3823 - DNA, 497 bp, synthetic construct; identical to SEQ ID NO: 2596
  misc_feature 1..497: note = Synthetic polypeptide
  source 1..497: mol_type = other DNA

SEQ ID NO: 3824 - DNA, 412 bp, synthetic construct; identical to SEQ ID NO: 2597
  misc_feature 1..412: note = Synthetic polypeptide
  source 1..412: mol_type = other DNA

SEQ ID NO: 3825 - DNA, 303 bp, synthetic construct; identical to SEQ ID NO: 148
  misc_feature 1..303: note = Synthetic polypeptide
  source 1..303: mol_type = other DNA

SEQ ID NO: 3826 - DNA, 301 bp, synthetic construct; identical to SEQ ID NO: 147
  misc_feature 1..301: note = Synthetic polypeptide
  source 1..301: mol_type = other DNA

SEQ ID NO: 3827 - DNA, 857 bp, synthetic construct; identical to SEQ ID NO: 1374
  misc_feature 1..857: note = Synthetic polypeptide
  source 1..857: mol_type = other DNA

SEQ ID NO: 3828 - DNA, 1493 bp, synthetic construct; identical to SEQ ID NO: 1536
  misc_feature 1..1493: note = Synthetic polypeptide
  source 1..1493: mol_type = other DNA

SEQ ID NO: 3829 - DNA, 1206 bp, synthetic construct; identical to SEQ ID NO: 282
  misc_feature 1..1206: note = Synthetic polypeptide
  source 1..1206: mol_type = other DNA

SEQ ID NO: 3830 - DNA, 1209 bp, synthetic construct; identical to SEQ ID NO: 281
  misc_feature 1..1209: note = Synthetic polypeptide
  source 1..1209: mol_type = other DNA

SEQ ID NO: 3831 - DNA, 1203 bp, synthetic construct; identical to SEQ ID NO: 286
  misc_feature 1..1203: note = Synthetic polypeptide
  source 1..1203: mol_type = other DNA

SEQ ID NO: 3832 - DNA, 1094 bp, synthetic construct; identical to SEQ ID NO: 153
  misc_feature 1..1094: note = Synthetic polypeptide
  source 1..1094: mol_type = other DNA

SEQ ID NO: 3833 - DNA, 128 bp, synthetic construct; identical to SEQ ID NO: 144
  misc_feature 1..128: note = Synthetic polypeptide
  source 1..128: mol_type = other DNA

SEQ ID NO: 3834 - DNA, 121 bp, synthetic construct; identical to SEQ ID NO: 2158
  misc_feature 1..121: note = Synthetic polypeptide
  source 1..121: mol_type = other DNA

SEQ ID NO: 3835 - DNA, 1216 bp, synthetic construct; identical to SEQ ID NO: 1380
  misc_feature 1..1216: note = Synthetic polypeptide
  source 1..1216: mol_type = other DNA

SEQ ID NO: 3836 - DNA, 531 bp, synthetic construct; identical to SEQ ID NO: 2507
  misc_feature 1..531: note = Synthetic polypeptide
  source 1..531: mol_type = other DNA

SEQ ID NO: 3837 - DNA, 294 bp, synthetic construct; identical to SEQ ID NO: 2508
  misc_feature 1..294: note = Synthetic polypeptide
  source 1..294: mol_type = other DNA

SEQ ID NO: 3838 - DNA, 316 bp, synthetic construct; identical to SEQ ID NO: 2509
  misc_feature 1..316: note = Synthetic polypeptide
  source 1..316: mol_type = other DNA

SEQ ID NO: 3839 - DNA, 798 bp, synthetic construct
  misc_feature 1..798: note = Synthetic polypeptide
  source 1..798: mol_type = other DNA
atggacgcgctcaagtcggcggggcgggcgctgatccggagccccagcttggccaagcagagctgggggggcggtggccggcaccgcaagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagctaaggccagtgggaagaagctgcagaaggtgactctgaaggtgtcgccacggggaattatcctgacagacaacctcaccaaccagctcattgagaacgtgtccatatacaggatctcctattgcacagcagacaagatgcacgacaaggtgtttgcatacatcgcccagagccagcacaaccagagcctcgagtgccacgccttcctctgcaccaagcggaagatggcacaggctgttaccctcaccgtagcccaggccttcaaagtcgcctttgagttttggcaggtgtccaaggaagagaaagagaagagggacaaagccagccaagagggaggggacgtcctgggggcccgccaagactgcaccccctccttgaagagcttggtcgccactgggaacctgctggacttagaggagacagctaaggccccgctgtccacggtcagcgccaacaccaccaacatggacgaggtgccgcggccacaagccttgagtggcagcagtgttgtctgggagctggatgatggcctggatgaagcgttttcgagagatcctgactaatac

SEQ ID NO: 3840 - DNA, 1363 bp, synthetic construct; identical to SEQ ID NO: 209
  misc_feature 1..1363: note = Synthetic polypeptide
  source 1..1363: mol_type = other DNA

SEQ ID NO: 3841 - DNA, 803 bp, synthetic construct; identical to SEQ ID NO: 152
  misc_feature 1..803: note = Synthetic polypeptide
  source 1..803: mol_type = other DNA

SEQ ID NO: 3842 - DNA, 168 bp, synthetic construct
  misc_feature 1..168: note = Synthetic polypeptide
  source 1..168: mol_type = other DNA
atgacccactctttggtttgtccagagacagtgagcagggtgagttcagtgctgaatcgcaacactcggcagtttggaaaaaaacatcttttcgaccaggatgaggagacatgttggaactcagaccaggactccactttttctgtaaaatggtgctgatgaccacct

SEQ ID NO: 3843 - DNA, 93 bp, synthetic construct
  misc_feature 1..93: note = Synthetic polypeptide
  source 1..93: mol_type = other DNA
ggaaaaaaacatcttttcgaccaggatgaggagacatgttggaactcagaccaggactccactttttctgtaaaatggtgctgatgaccacct

SEQ ID NO: 3844 - DNA, 1097 bp, synthetic construct; identical to SEQ ID NO: 1040
  misc_feature 1..1097: note = Synthetic polypeptide
  source 1..1097: mol_type = other DNA

SEQ ID NO: 3845 - DNA, 965 bp, synthetic construct; identical to SEQ ID NO: 1041
  misc_feature 1..965: note = Synthetic polypeptide
  source 1..965: mol_type = other DNA

SEQ ID NO: 3846 - DNA, 1736 bp, synthetic construct; identical to SEQ ID NO: 156
  misc_feature 1..1736: note = Synthetic polypeptide
  source 1..1736: mol_type = other DNA

SEQ ID NO: 3847 - DNA, 1724 bp, synthetic construct; identical to SEQ ID NO: 157
  misc_feature 1..1724: note = Synthetic polypeptide
  source 1..1724: mol_type = other DNA

SEQ ID NO: 3848 - DNA, 168 bp, synthetic construct; identical to SEQ ID NO: 2538
  misc_feature 1..168: note = Synthetic polypeptide
  source 1..168: mol_type = other DNA

SEQ ID NO: 3849 - DNA, 2557 bp, synthetic construct; identical to SEQ ID NO: 1524
  misc_feature 1..2557: note = Synthetic polypeptide
  source 1..2557: mol_type = other DNA

SEQ ID NO: 3850 - DNA, 2428 bp, synthetic construct; identical to SEQ ID NO: 1525
  misc_feature 1..2428: note = Synthetic polypeptide
  source 1..2428: mol_type = other DNA

SEQ ID NO: 3851 - DNA, 137 bp, synthetic construct
  misc_feature 1..137: note = Synthetic polypeptide
  source 1..137: mol_type = other DNA
atgtgttctgaaattattttgaggcaagaagttttgaaagatggtttccacagttgattctaaatgaccaagctgtttccaaaaaagaaattatcttcaaaagatgaatatttgcccatattgaagatctttaaaag

SEQ ID NO: 3852 - DNA, 260 bp, synthetic construct
  misc_feature 1..260: note = Synthetic polypeptide
  source 1..260: mol_type = other DNA
ctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagttgattctaaatgaccaagctgtttccaaaaaagaaattatcttcaaaagatgaatatttgcccatattgaagatctttaaaag

SEQ ID NO: 3853 - DNA, 233 bp, synthetic construct
  misc_feature 1..233: note = Synthetic polypeptide
  source 1..233: mol_type = other DNA
gcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagttgattctaaatgaccaagctgtttccaaaaaagaaattatcttcaaaagatgaatatttgcccatattgaagatctttaaaag

SEQ ID NO: 3854 - DNA, 562 bp, synthetic construct; identical to SEQ ID NO: 1880
  misc_feature 1..562: note = Synthetic polypeptide
  source 1..562: mol_type = other DNA

SEQ ID NO: 3855 - DNA, 519 bp, synthetic construct; identical to SEQ ID NO: 1571
  misc_feature 1..519: note = Synthetic polypeptide
  source 1..519: mol_type = other DNA

SEQ ID NO: 3856 - DNA, 723 bp, synthetic construct; identical to SEQ ID NO: 1572
  misc_feature 1..723: note = Synthetic polypeptide
  source 1..723: mol_type = other DNA

SEQ ID NO: 3857 - DNA, 483 bp, synthetic construct; identical to SEQ ID NO: 1573
  misc_feature 1..483: note = Synthetic polypeptide
  source 1..483: mol_type = other DNA

SEQ ID NO: 3858 - DNA, 516 bp, synthetic construct; identical to SEQ ID NO: 1574
  misc_feature 1..516: note = Synthetic polypeptide
  source 1..516: mol_type = other DNA

SEQ ID NO: 3859 - DNA, 117 bp, synthetic construct; identical to SEQ ID NO: 1575
  misc_feature 1..117: note = Synthetic polypeptide
  source 1..117: mol_type = other DNA

SEQ ID NO: 3860 - DNA, 535 bp, synthetic construct; identical to SEQ ID NO: 2819
  misc_feature 1..535: note = Synthetic polypeptide
  source 1..535: mol_type = other DNA

SEQ ID NO: 3861 - DNA, 5505 bp, synthetic construct; identical to SEQ ID NO: 1545
  misc_feature 1..5505: note = Synthetic polypeptide
  source 1..5505: mol_type = other DNA

SEQ ID NO: 3862 - DNA, 5418 bp, synthetic construct; identical to SEQ ID NO: 1546
  misc_feature 1..5418: note = Synthetic polypeptide
  source 1..5418: mol_type = other DNA

SEQ ID NO: 3863 - DNA, 1213 bp, synthetic construct; identical to SEQ ID NO: 1093
  misc_feature 1..1213: note = Synthetic polypeptide
  source 1..1213: mol_type = other DNA

SEQ ID NO: 3864 - DNA, 616 bp, synthetic construct; identical to SEQ ID NO: 1094
  misc_feature 1..616: note = Synthetic polypeptide
  source 1..616: mol_type = other DNA

SEQ ID NO: 3865 - DNA, 868 bp, synthetic construct; identical to SEQ ID NO: 1095
  misc_feature 1..868: note = Synthetic polypeptide
  source 1..868: mol_type = other DNA

SEQ ID NO: 3866 - DNA, 729 bp, synthetic construct; identical to SEQ ID NO: 202
  misc_feature 1..729: note = Synthetic polypeptide
  source 1..729: mol_type = other DNA

SEQ ID NO: 3867 - DNA, 569 bp, synthetic construct; identical to SEQ ID NO: 426
  misc_feature 1..569: note = Synthetic polypeptide
  source 1..569: mol_type = other DNA

SEQ ID NO: 3868 - DNA, 1520 bp, synthetic construct; identical to SEQ ID NO: 175
  misc_feature 1..1520: note = Synthetic polypeptide
  source 1..1520: mol_type = other DNA

SEQ ID NO: 3869 - DNA, 1436 bp, synthetic construct; identical to SEQ ID NO: 176
  misc_feature 1..1436: note = Synthetic polypeptide
  source 1..1436: mol_type = other DNA

SEQ ID NO: 3870 - DNA, 1265 bp, synthetic construct; identical to SEQ ID NO: 177
  misc_feature 1..1265: note = Synthetic polypeptide
  source 1..1265: mol_type = other DNA

SEQ ID NO: 3871 - DNA, 1259 bp, synthetic construct
  misc_feature 1..1259: note = Synthetic polypeptide
  source 1..1259: mol_type = other DNA
atgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtgctg

SEQ ID NO: 3872 - DNA, 897 bp, synthetic construct; identical to SEQ ID NO: 2579
  misc_feature 1..897: note = Synthetic polypeptide
  source 1..897: mol_type = other DNA

SEQ ID NO: 3873 - DNA, 839 bp, synthetic construct
  misc_feature 1..839: note = Synthetic polypeptide
  source 1..839: mol_type = other DNA
atggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaagccagggctttgtctgtatcattactgctgtatccctgacagctggaa

SEQ ID NO: 3874 - DNA, 239 bp, synthetic construct
  misc_feature 1..239: note = Synthetic polypeptide
  source 1..239: mol_type = other DNA
gcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaagccagggctttgtctgtatcattactgctgtatccctgacagctggaa

SEQ ID NO: 3875 - DNA, 441 bp, synthetic construct
  misc_feature 1..441: note = Synthetic polypeptide
  source 1..441: mol_type = other DNA
atgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggcacagaaaatctgctaaggcagtaagaatttgcgaagtcaagatctagaggaaaagaagaaaaagttccagatatgtgagccctacatgtagggctgttt

SEQ ID NO: 3876 - DNA, 715 bp, synthetic construct; identical to SEQ ID NO: 1181
  misc_feature 1..715: note = Synthetic polypeptide
  source 1..715: mol_type = other DNA

SEQ ID NO: 3877 - DNA, 589 bp, synthetic construct; identical to SEQ ID NO: 1182
  misc_feature 1..589: note = Synthetic polypeptide
  source 1..589: mol_type = other DNA

SEQ ID NO: 3878 - DNA, 352 bp, synthetic construct; identical to SEQ ID NO: 1183
  misc_feature 1..352: note = Synthetic polypeptide
  source 1..352: mol_type = other DNA

SEQ ID NO: 3879 - DNA, 180 bp, synthetic construct; identical to SEQ ID NO: 1184
  misc_feature 1..180: note = Synthetic polypeptide
  source 1..180: mol_type = other DNA

SEQ ID NO: 3880 - DNA, 226 bp, synthetic construct; identical to SEQ ID NO: 1185
  misc_feature 1..226: note = Synthetic polypeptide
  source 1..226: mol_type = other DNA

SEQ ID NO: 3881 - DNA, 280 bp, synthetic construct; identical to SEQ ID NO: 1186
  misc_feature 1..280: note = Synthetic polypeptide
  source 1..280: mol_type = other DNA

SEQ ID NO: 3882 - DNA, 1288 bp, synthetic construct
  misc_feature 1..1288: note = Synthetic polypeptide
  source 1..1288: mol_type = other DNA
atggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgctccatagtttccagcaaaact

SEQ ID NO: 3883 - DNA, 535 bp, synthetic construct; identical to SEQ ID NO: 2819
  misc_feature 1..535: note = Synthetic polypeptide
  source 1..535: mol_type = other DNA

SEQ ID NO: 3884 - DNA, 912 bp, synthetic construct
  misc_feature 1..912: note = Synthetic polypeptide
  source 1..912: mol_type = other DNA
atggcctgccgcccgcgaagcccgccgaggcatcagagccgctgcgacggtgacgccagctttaccactcctgaaggccctaaaccccgttccagatgctctgactgggcaagtgcagttgaagaagatgaaatgaggaccagagttaacaaagaaatggcaagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgagcccaagatggtgctagtctgaaaagccccacaggtgtggcttctaatgaactgaaccctattaagagtcacagaattaacatgggcggaagctgctgccaggctggactgaaagggccaggcaatacaagaggccttgaaccctcaggttcctaccagcgggaagtaggaagataaaactctccagctgcaaacacaggctgccttttgtgaaaaagaaggataattcagagatggagccaggagcctggaggactgaggctggcttaggggactgccaggtgatgtgtgcccagctggatttcagacttgctgtgggccagggactcct

SEQ ID NO: 3885 - DNA, 1029 bp, synthetic construct
  misc_feature 1..1029: note = Synthetic polypeptide
  source 1..1029: mol_type = other DNA
atggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagctttaccactcctgaaggccctaaaccccgttccagatgctctgactgggcaagtgcagttgaagaagatgaaatgaggaccagagttaacaaagaaatggcaagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgagcccaagatggtgctagtctgaaaagccccacaggtgtggcttctaatgaactgaaccctattaagagtcacagaattaacatgggcggaagctgctgccaggctggactgaaagggccaggcaatacaagaggccttgaaccctcaggttcctaccagcgggaagtaggaagataaaactctccagctgcaaacacaggctgccttttgtgaaaaagaaggataattcagagatggagccaggagcctggaggactgaggctggcttaggggactgccaggtgatgtgtgcccagctggatttcagacttgctgtgggccagggactcct

SEQ ID NO: 3886 - DNA, 1050 bp, synthetic construct
  misc_feature 1..1050: note = Synthetic polypeptide
  source 1..1050: mol_type = other DNA
atggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagctttaccactcctgaaggccctaaaccccgttccagatgctctgactgggcaagtgcagttgaagaagatgaaatgaggaccagagttaacaaagaaatggcaagcaatatttattttgccctcagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgagcccaagatggtgctagtctgaaaagccccacaggtgtggcttctaatgaactgaaccctattaagagtcacagaattaacatgggcggaagctgctgccaggctggactgaaagggccaggcaatacaagaggccttgaaccctcaggttcctaccagcgggaagtaggaagataaaactctccagctgcaaacacaggctgccttttgtgaaaaagaaggataattcagagatggagccaggagcctggaggactgaggctggcttaggggactgccaggtgatgtgtgcccagctggatttcagacttgctgtgggccagggactcct

SEQ ID NO: 3887 - DNA, 893 bp, synthetic construct
  misc_feature 1..893: note = Synthetic polypeptide
  source 1..893: mol_type = other DNA
gcccagccgaccgcgtccctccccgcagcccgccgtcccccgcgcgatggagcctgggacggaagcgcagagccgacggcaggcgctggaggcccgaagacgccgaggaggcagagcaccgcggcgccgagcgcagacccgagagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgagcccaagatggtgctagtctgaaaagccccacaggtgtggcttctaatgaactgaaccctattaagagtcacagaattaacatgggcggaagctgctgccaggctggactgaaagggccaggcaatacaagaggccttgaaccctcaggttcctaccagcgggaagtaggaagataaaactctccagctgcaaacacaggctgccttttgtgaaaaagaaggataattcagagatggagccaggagcctggaggactgaggctggcttaggggactgccaggtgatgtgtgcccagctggatttcagacttgctgtgggccagggactcct

SEQ ID NO: 3888 - DNA, 924 bp, synthetic construct
  misc_feature 1..924: note = Synthetic polypeptide
  source 1..924: mol_type = other DNA
atggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgagcccaagatggtgctagtctgaaaagccccacaggtgtggcttctaatgaactgaaccctattaagagtcacagaattaacatgggcggaagctgctgccaggctggactgaaagggccaggcaatacaagaggccttgaaccctcaggttcctaccagcgggaagtaggaagataaaactctccagctgcaaacacaggctgccttttgtgaaaaagaaggataattcagagatggagccaggagcctggaggactgaggctggcttaggggactgccaggtgatgtgtgcccagctggatttcagacttgctgtgggccagggactcct

SEQ ID NO: 3889 - DNA, 4061 bp, synthetic construct
  misc_feature 1..4061: note = Synthetic polypeptide
  source 1..4061: mol_type = other DNA
atggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtctctagtaacttataaaaagccgagtcattccttttgggagcctggcaaagggaagagagtccttcttgaccttcggccgaaacacccttaaa

SEQ ID NO: 3890 - DNA, 3893 bp, synthetic construct
  misc_feature 1..3893: note = Synthetic polypeptide
  source 1..3893: mol_type = other DNA
atggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtctctagtaacttataaaaagccgagtcattccttttgggagcctggcaaagggaagagagtccttcttgaccttcggccgaaacacccttaaa

SEQ ID NO: 3891 - DNA, 3716 bp, synthetic construct
  misc_feature 1..3716: note = Synthetic polypeptide
  source 1..3716: mol_type = other DNA
atggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtctctagtaacttataaaaagccgagtcattccttttgggagcctggcaaagggaagagagtccttcttgaccttcggccgaaacacccttaaa

SEQ ID NO: 3892 - DNA, 3884 bp, synthetic construct
  misc_feature 1..3884: note = Synthetic polypeptide
  source 1..3884: mol_type = other DNA
atggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtctctagtaacttataaaaagccgagtcattccttttgggagcctggcaaagggaagagagtccttcttgaccttcggccgaaacacccttaaa

SEQ ID NO: 3893 - DNA, 4091 bp, synthetic construct
  misc_feature 1..4091: note = Synthetic polypeptide
  source 1..4091: mol_type = other DNA
atggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtctctagtaacttataaaaagccgagtcattccttttgggagcctggcaaagggaagagagtccttcttgaccttcggccgaaacacccttaaa

SEQ ID NO: 3894 - DNA, 3786 bp, synthetic construct
  misc_feature 1..3786: note = Synthetic polypeptide
  source 1..3786: mol_type = other DNA
ggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtctctagtaacttataaaaagccgagtcattccttttgggagcctggcaaagggaagagagtccttcttgaccttcggccgaaacacccttaaa

SEQ ID NO: 3895 - DNA, 393 bp, synthetic construct; identical to SEQ ID NO: 1400
  misc_feature 1..393: note = Synthetic polypeptide
  source 1..393: mol_type = other DNA

SEQ ID NO: 3896 - DNA, 272 bp, synthetic construct; identical to SEQ ID NO: 1401
  misc_feature 1..272: note = Synthetic polypeptide
  source 1..272: mol_type = other DNA

SEQ ID NO: 3897 - DNA, 925 bp, synthetic construct; identical to SEQ ID NO: 1209
  misc_feature 1..925: note = Synthetic polypeptide
  source 1..925: mol_type = other DNA

SEQ ID NO: 3898 - DNA, 736 bp, synthetic construct; identical to SEQ ID NO: 1210
  misc_feature 1..736: note = Synthetic polypeptide
  source 1..736: mol_type = other DNA

SEQ ID NO: 3899 - DNA, 755 bp, synthetic construct; identical to SEQ ID NO: 1211
  misc_feature 1..755: note = Synthetic polypeptide
  source 1..755: mol_type = other DNA

SEQ ID NO: 3900 - DNA, 424 bp, synthetic construct; identical to SEQ ID NO: 1212
  misc_feature 1..424: note = Synthetic polypeptide
  source 1..424: mol_type = other DNA

SEQ ID NO: 3901 - DNA, 285 bp, synthetic construct
  misc_feature 1..285: note = Synthetic polypeptide
  source 1..285: mol_type = other DNA
atgaacgggacgcggaactggtgtaccctggtggacgtgcacccagaggaccaggcggcggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtctgggatgtagaaggcatcagtaaatgtttgttagactgaacagat

SEQ ID NO: 3902 - DNA, 462 bp, synthetic construct
  misc_feature 1..462: note = Synthetic polypeptide
  source 1..462: mol_type = other DNA
atgaacgggacgcggaactggtgtaccctggtggacgtgcacccagaggaccaggcggcgggcagcgtggacattctcaggctgactctccagggtgaactgacaggagatgaacttgaacacatagcccagaaggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtctgggatgtagaaggcatcagtaaatgtttgttagactgaacagat

SEQ ID NO: 3903 - DNA, 387 bp, synthetic construct
  misc_feature 1..387: note = Synthetic polypeptide
  source 1..387: mol_type = other DNA
atgaacgggacgcggaactggtgtaccctggtggacgtgcacccagaggaccaggcggcggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtctgggatgtagaaggcatcagtaaatgtttgttagactgaacagat

SEQ ID NO: 3904 - DNA, 519 bp, synthetic construct
  misc_feature 1..519: note = Synthetic polypeptide
  source 1..519: mol_type = other DNA
atgagcagtccaggaatgacctctctacaactagagaaagaagaatgcatgcaatgtgttccctgtagtccaagaaccagggtagccctgctggagctctacagagccatgtgccagggcagcgtggacattctcaggctgactctccagggtgaactgacaggagatgaacttgaacacatagcccagaaggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtctgggatgtagaaggcatcagtaaatgtttgttagactgaacagat

SEQ ID NO: 3905 - DNA, 973 bp, synthetic construct
  misc_feature 1..973: note = Synthetic polypeptide
  source 1..973: mol_type = other DNA
atgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggagggcaacagtcagaaaaattaagacaacttaaaatggaaaatctattctcagcagaaattttttgtaagtataaaaaaacgaaaatgagactataaccactgtaagtttctgattggcacatttgttacccaagcaaggagatccatttatcagtagtgattttattaaatcatgtttgattgcagccgctgaagaagtatgtgcactgaaaataaacttaagactatttaatggcgagagcagttgctcaaagagttgaggatatggggagatacagcaatatttaatttaaaaaacaaggcatatgatttcaaatgttttttggggtctta

SEQ ID NO: 3906 - DNA, 763 bp, synthetic construct
  misc_feature 1..763: note = Synthetic polypeptide
  source 1..763: mol_type = other DNA
atgttgtcccgaaggtacgaaggcgaaatacccaaaaatatttgcaagaggaagaaaacagtccaccaagtgacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggagggcaacagtcagaaaaattaagacaacttaaaatggaaaatctattctcagcagaaattttttgtaagtataaaaaaacgaaaatgagactataaccactgtaagtttctgattggcacatttgttacccaagcaaggagatccatttatcagtagtgattttattaaatcatgtttgattgcagccgctgaagaagtatgtgcactgaaaataaacttaagactatttaatggcgagagcagttgctcaaagagttgaggatatggggagatacagcaatatttaatttaaaaaacaaggcatatgatttcaaatgttttttggggtctta

SEQ ID NO: 3907 - DNA, 770 bp, synthetic construct; identical to SEQ ID NO: 3389
  misc_feature 1..770: note = Synthetic polypeptide
  source 1..770: mol_type = other DNA

SEQ ID NO: 3908 - DNA, 503 bp, synthetic construct; identical to SEQ ID NO: 322
  misc_feature 1..503: note = Synthetic polypeptide
  source 1..503: mol_type = other DNA

SEQ ID NO: 3909 - DNA, 1470 bp, synthetic construct; identical to SEQ ID NO: 1592
  misc_feature 1..1470: note = Synthetic polypeptide
  source 1..1470: mol_type = other DNA

SEQ ID NO: 3910 - DNA, 202 bp, synthetic construct; identical to SEQ ID NO: 1593
  misc_feature 1..202: note = Synthetic polypeptide
  source 1..202: mol_type = other DNA

SEQ ID NO: 3911 - DNA, 569 bp, synthetic construct; identical to SEQ ID NO: 1768
  misc_feature 1..569: note = Synthetic polypeptide
  source 1..569: mol_type = other DNA

SEQ ID NO: 3912 - DNA, 497 bp, synthetic construct; identical to SEQ ID NO: 1769
  misc_feature 1..497: note = Synthetic polypeptide
  source 1..497: mol_type = other DNA

SEQ ID NO: 3913 - DNA, 1761 bp, synthetic construct
  misc_feature 1..1761: note = Synthetic polypeptide
  source 1..1761: mol_type = other DNA
atggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggaggatcacttcagcccaggagttcaagactagcctgtgccacatagaccacatttctaccaaaaatcaaaaggaaaaaacttgctgggtgtggtgatgcacacctgtggtcccagctactcgggaggctgaggtgagaggattgctttagcttaggtggttgaggctgcagtgagccatgatagcaccactgcattccatccagcctgagggacggagtgagagcgacaccttgtctttaaaaaaaaaaa

SEQ ID NO: 3914 - DNA, 1563 bp, synthetic construct
  misc_feature 1..1563: note = Synthetic polypeptide
  source 1..1563: mol_type = other DNA
atggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggaggatcacttcagcccaggagttcaagactagcctgtgccacatagaccacatttctaccaaaaatcaaaaggaaaaaacttgctgggtgtggtgatgcacacctgtggtcccagctactcgggaggctgaggtgagaggattgctttagcttaggtggttgaggctgcagtgagccatgatagcaccactgcattccatccagcctgagggacggagtgagagcgacaccttgtctttaaaaaaaaaaa

SEQ ID NO: 3915 - DNA, 92 bp, synthetic construct; identical to SEQ ID NO: 1765
  misc_feature 1..92: note = Synthetic polypeptide
  source 1..92: mol_type = other DNA

SEQ ID NO: 3916 - DNA, 801 bp, synthetic construct
  misc_feature 1..801: note = Synthetic polypeptide
  source 1..801: mol_type = other DNA
atgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccggggaatgaatggaaaaatcatctgtgttgcgttcacttaattgaataccaccaaacaaaaaaaggaatgaatgattgacatccccaacatcttggatggatgtaaaaagcttatgccaagtgaaataagccaatcactaaaaggctgtatgtatgattgattgc

SEQ ID NO: 3917 - DNA, 591 bp, synthetic construct
  misc_feature 1..591: note = Synthetic polypeptide
  source 1..591: mol_type = other DNA
atgttgtcccgaaggtacgaaggcgaaatacccaaaaatatttgcaagaggaagaaaacagtccaccaagtgacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccggggaatgaatggaaaaatcatctgtgttgcgttcacttaattgaataccaccaaacaaaaaaaggaatgaatgattgacatccccaacatcttggatggatgtaaaaagcttatgccaagtgaaataagccaatcactaaaaggctgtatgtatgattgattgc

SEQ ID NO: 3918 - DNA, 517 bp, synthetic construct; identical to SEQ ID NO: 1304
  misc_feature 1..517: note = Synthetic polypeptide
  source 1..517: mol_type = other DNA

SEQ ID NO: 3919 - DNA, 337 bp, synthetic construct; identical to SEQ ID NO: 1305
  misc_feature 1..337: note = Synthetic polypeptide
  source 1..337: mol_type = other DNA

SEQ ID NO: 3920 - DNA, 746 bp, synthetic construct
  misc_feature 1..746: note = Synthetic polypeptide
  source 1..746: mol_type = other DNA
atggcctggtcccctctcttcctcaccctcatcactcactgtgcagggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcaatggcctccagtgattccccaccctctggtattcctatctgtatatggtccattcccacatagcatcagggttgctctgggtgaccaagagtatacaacagagtgaagttattttacctccaaggctattataaaaaacattgcaatgccttccttgttctcttttggatcactcattctgtaggaagccagctgacatgtcatgaggaccatatgacaaggaacagagggaggcctcctgccaatacccaagtgagtttgaaagccctagtcaagcctttcacatgatatggccccagtcaacatcttaactgcaacctcatgaaagaagctgagacagcaccactcagttaagtgaccccaaattcctgaccctcggaaaccatgagataacaaatagtggtggttttagttgataagtttgcagtaatatattatacagcaataggtaactaataca

SEQ ID NO: 3921 - DNA, 3525 bp, synthetic construct; identical to SEQ ID NO: 214
  misc_feature 1..3525: note = Synthetic polypeptide
  source 1..3525: mol_type = other DNA

SEQ ID NO: 3922 - DNA, 1134 bp, synthetic construct
  misc_feature 1..1134: note = Synthetic polypeptide
  source 1..1134: mol_type = other DNA
atggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggttccgctgtgtggcagctgattgcttccttcctgaggcttccaatctcaggaacgcactgcattgtgggttctactataggattctcactggtcgcaatcggtaccaaaggtgtgcagtggatggagcttgtcaagattgttgcttcttggtttatatctccactgttgtctggtttcatgtctggcctgctgtttgtactcatcagaattttcatcttaaaaaaggaagaccctgttcccaatggcctccgggcactcccagtattctatgctgctaccatagcaatcaatgtcttttccatcatgtacacaggagcaccagtgctcggccttgttctccccatgtgggccatagccctcatttcctttggtgtcgccctcctgttcgctttttttgtgtggctcttcgtgtgtccgtggatgcggaggaaaataacaggcaaatgggtaaccaaattgagtaaattcatgcgatggacgaccacgcagcaatagagagaatgaactgctggggacctgacggctgaaggcatcctacagccgtgatactgagcagaagcccatgatccggaagagcacctattctgcatgctggcatttttcataacattttcttaaatttttatttaaaagttttatggatctttccattaaatttaagaatatggaaaattcatctatagcaacagaaagcactgatcgcctgggatgggtgggggttggagaaggcagctcaggaacttatcagggacatgaaatgtctttgttttcatcagggaaggggtttagagtgtgcccacttgcggcaggtcataacctggatgcttaaaatgtatgcatttt

SEQ ID NO: 3923 - DNA, 431 bp, synthetic construct; identical to SEQ ID NO: 364
  misc_feature 1..431: note = Synthetic polypeptide
  source 1..431: mol_type = other DNA

SEQ ID NO: 3924 - DNA, 6132 bp, synthetic construct; identical to SEQ ID NO: 1117
  misc_feature 1..6132: note = Synthetic polypeptide
  source 1..6132: mol_type = other DNA

SEQ ID NO: 3925 - DNA, 615 bp, synthetic construct; identical to SEQ ID NO: 1055
  misc_feature 1..615: note = Synthetic polypeptide
  source 1..615: mol_type = other DNA

SEQ ID NO: 3926 - DNA, 861 bp, synthetic construct; identical to SEQ ID NO: 1056
  misc_feature 1..861: note = Synthetic polypeptide
  source 1..861: mol_type = other DNA

SEQ ID NO: 3927 - DNA, 62 bp, synthetic construct; identical to SEQ ID NO: 1057
  misc_feature 1..62: note = Synthetic polypeptide
  source 1..62: mol_type = other DNA

SEQ ID NO: 3928 - DNA, 123 bp, synthetic construct; identical to SEQ ID NO: 1058
  misc_feature 1..123: note = Synthetic polypeptide
  source 1..123: mol_type = other DNA

SEQ ID NO: 3929 - DNA, 712 bp, synthetic construct; identical to SEQ ID NO: 1187
  misc_feature 1..712: note = Synthetic polypeptide
  source 1..712: mol_type = other DNA

SEQ ID NO: 3930 - DNA, 307 bp, synthetic construct; identical to SEQ ID NO: 2622
  misc_feature 1..307: note = Synthetic polypeptide
  source 1..307: mol_type = other DNA

SEQ ID NO: 3931 - DNA, 2621 bp, synthetic construct
  misc_feature 1..2621: note = Synthetic polypeptide
  source 1..2621: mol_type = other DNA
atgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccaactcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgtggaatctctgagcctggaccttttaagccaagaattgcttaaggtgtttcccacaccctgaattccagcagaacagctgacgccaactggtctgaaggccccaccaaggaaccgactcagctcaggaatgtggtttcttcatcccctatcccgtgacttcaccactcatactcaccaatcagcgatccccacgcctcagaccccatcacctgcccagacccctgaaaaacaccatccccaagcccctcgggaggtgggtttgaggtttcctcccatctcctcgcttggctgcccacgcgtcttggactttctctgtggcaactccctctctttcagtgtgctggtatatcaccatgcagtgggcaataggcc

SEQ ID NO: 3932 - DNA, 2450 bp, synthetic construct
  misc_feature 1..2450: note = Synthetic polypeptide
  source 1..2450: mol_type = other DNA
atgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccaactcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgtggaatctctgagcctggaccttttaagccaagaattgcttaaggtgtttcccacaccctgaattccagcagaacagctgacgccaactggtctgaaggccccaccaaggaaccgactcagctcaggaatgtggtttcttcatcccctatcccgtgacttcaccactcatactcaccaatcagcgatccccacgcctcagaccccatcacctgcccagacccctgaaaaacaccatccccaagcccctcgggaggtgggtttgaggtttcctcccatctcctcgcttggctgcccacgcgtcttggactttctctgtggcaactccctctctttcagtgtgctggtatatcaccatgcagtgggcaataggcc

SEQ ID NO: 3933 - DNA, 459 bp, synthetic construct; identical to SEQ ID NO: 237
  misc_feature 1..459: note = Synthetic polypeptide
  source 1..459: mol_type = other DNA

SEQ ID NO: 3934 - DNA, 1649 bp, synthetic construct; identical to SEQ ID NO: 2810
  misc_feature 1..1649: note = Synthetic polypeptide
  source 1..1649: mol_type = other DNA

SEQ ID NO: 3935 - DNA, 1508 bp, synthetic construct; identical to SEQ ID NO: 2811
  misc_feature 1..1508: note = Synthetic polypeptide
  source 1..1508: mol_type = other DNA

SEQ ID NO: 3936 - DNA, 782 bp, synthetic construct; identical to SEQ ID NO: 2812
  misc_feature 1..782: note = Synthetic polypeptide
  source 1..782: mol_type = other DNA

SEQ ID NO: 3937 - DNA, 1504 bp, synthetic construct; identical to SEQ ID NO: 2813
  misc_feature 1..1504: note = Synthetic polypeptide
  source 1..1504: mol_type = other DNA

SEQ ID NO: 3938 - DNA, 1007 bp, synthetic construct; identical to SEQ ID NO: 2814
  misc_feature 1..1007: note = Synthetic polypeptide
  source 1..1007: mol_type = other DNA

SEQ ID NO: 3939 - DNA, 1629 bp, synthetic construct; identical to SEQ ID NO: 2518
  misc_feature 1..1629: note = Synthetic polypeptide
  source 1..1629: mol_type = other DNA

SEQ ID NO: 3940 - DNA, 633 bp, synthetic construct
  misc_feature 1..633: note = Synthetic polypeptide
  source 1..633: mol_type = other DNA
atgcactggggggttggctttgcttcgtccaggccgtgcgtggtggatctgagctggaaccagagcatctccttcttcggctggtgggccgggtccgaggagcccttctccttttatggggacatcatcgctttccctttgcaggattacggtgggatcatggcagggctgggctccgatccctggtggaagaaaaccctttacttgaccgggggagctttgctggccgcagctgcgtatctgctccacgaactcctggtcattaggaaacagcaagagattgactctaaagatgctattattttgcatcagtttgcaagacctaacaatggtgttccaagtttatctcctttctgtttaaagatggaaacttatttaaggatggctgacttaccgtatcagaactattttggtggaaaactctctgctcaagggaaaatgccttggattgaatataatcatgaaaaagtttctggcacagaattcataattgactttctggaagagaagcttggagtgaatttaaacaaaaaccttggccctcatgaaagagccatctccagagcggtgaccaagatggtggaggagcacttctactgccttccagccgttaacctttgcttttggaataaa

SEQ ID NO: 3941 - DNA, 397 bp, synthetic construct; identical to SEQ ID NO: 3335
  misc_feature 1..397: note = Synthetic polypeptide
  source 1..397: mol_type = other DNA

SEQ ID NO: 3942 - DNA, 289 bp, synthetic construct; identical to SEQ ID NO: 3336
  misc_feature 1..289: note = Synthetic polypeptide
  source 1..289: mol_type = other DNA

SEQ ID NO: 3943 - DNA, 468 bp, synthetic construct; identical to SEQ ID NO: 2580
  misc_feature 1..468: note = Synthetic polypeptide
  source 1..468: mol_type = other DNA

SEQ ID NO: 3944 - DNA, 436 bp, synthetic construct
  misc_feature 1..436: note = Synthetic polypeptide
  source 1..436: mol_type = other DNA
atggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagttagcaaagtgcctggcacata

SEQ ID NO: 3945 - DNA, 426 bp, synthetic construct
  misc_feature 1..426: note = Synthetic polypeptide
  source 1..426: mol_type = other DNA
tggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagttagcaaagtgcctggcacata

SEQ ID NO: 3946 - DNA, 244 bp, synthetic construct
  misc_feature 1..244: note = Synthetic polypeptide
  source 1..244: mol_type = other DNA
atcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagttagcaaagtgcctggcacata

SEQ ID NO: 3947 - DNA, 193 bp, synthetic construct; identical to SEQ ID NO: 975
  misc_feature 1..193: note = Synthetic polypeptide
  source 1..193: mol_type = other DNA

SEQ ID NO: 3948 - DNA, 1476 bp, synthetic construct
  misc_feature 1..1476: note = Synthetic polypeptide
  source 1..1476: mol_type = other DNA
atggcttgggccgcgctcctcggcctcctggccgcactgttgctgctgctgctactgagccgccgccgcacgcggcgacctggtgagcctcccctggacctgggcagcatcccctggttggggtatgccttggactttggaaaagatgctgccagcttcctcacgaggatgaaggagaagcacggtgacatctttactatactggttgggggcaggtatgtcaccgttctcctggacccacactcctacgacgcggtggtgtgggagcctcgcaccaggctcgacttccatgcctatgccatcttcctcatggagaggatttttgatgtgcagcttccacattacagccccagtgatgaaaaggccaggatgaaactgactcttctccacagagagctccaggcactcacagaagccatgtataccaacctccatgcagtgctgttgggcgatgctacagaagcaggcagtggctggcacgagatgggtctcctcgacttctcctacagcttcctgctcagagccggctacctgactctttacggaattgaggcgctgccacgcacccatgaaagccaggcccaggaccgcgtccactcagctgatgtcttccacacctttcgccagctcgaccggctgctccccaaactggcccgtggctccctgtcagtgggggacaaggaccacatgtgcagtgtcaaaagtcgcctgtggaagctgctatccccagccaggctggccaggcgggcccaccggagcaaatggctggagagttacctgctgcacctggaggagatgggtgtgtcagaggagatgcaggcacgggccctggtgctgcagctgtgggccacacaggggaatatgggtcccgctgccttctggctcctgctcttccttctcaagaatcctgaagccctggctgctgtccgcggagagctcgagagtatcctttggcaagcggagcagcctgtctcgcagacgaccactctcccacagaaggttctagacagcacacctgtgcttgatagcgtgctgagtgagagcctcaggcttacagctgcccccttcatcacccgcgaggttgtggtggacctggccatgcccatggcagacgggcgagaattcaacctgcgacgtggtgaccgcctcctcctcttccccttcctgagcccccagagagacccagaaatctacacagacccagaggtatttaaatacaaccgattcctgaaccctgacggatcagagaagaaagacttttacaaggatgggaaacggctgaagaattacaacatgccctggggggcggggcacaatcactgcctggggaggagttatgcggtcaacagcatcaaacaatttgtgttccttgtgctggtgcacttggacttggagctgatcaacgcagatgtggagatccctgagtttgacctcagcagcgcctcctggacctgaaggcatctgagtgtgagaccc

SEQ ID NO: 3949 - DNA, 377 bp, synthetic construct; identical to SEQ ID NO: 2235
  misc_feature 1..377: note = Synthetic polypeptide
  source 1..377: mol_type = other DNA

SEQ ID NO: 3950 - DNA, 347 bp, synthetic construct; identical to SEQ ID NO: 2236
  misc_feature 1..347: note = Synthetic polypeptide
  source 1..347: mol_type = other DNA

SEQ ID NO: 3951 - DNA, 658 bp, synthetic construct
  misc_feature 1..658: note = Synthetic polypeptide
  source 1..658: mol_type = other DNA
atgaagcttcttcatgttttcctgttatttctgtgcttccacttaaggttttgcaaggtttcagtagaagatttgagcaggcagaagaaatagtcaacaaacttgaagatcagtccatttaattaattatccagtatgagaagcagaaagaaaaaaggatgacaaggaatgaacagagcctatgagactcgtgtgacaccataaagcataccaaaatatatataatggaaccccagaaggagaaaataagaaagtaagagagaatatatgaagaaataatggctgaaaaatttccacatttgatcaaatgcatggctgtccacattcaaaaagctcaatgcaatccaagaaggataaacacaaaaaggttcaaaccaagacacattataatcaaattgtcaaaaccaaggatgaagaaagtcttgaaaacaacatagtcatgagattccgtaagattagcagcagctttctcatcagaaaccatggagggcagatgaaaattttatttgttgaaagtaaaaaactgtcaaccaagaattctgtatctggcaaaactatccttcacaaatgaaggagaaatgaagaaattcacagataaatagaggctgaaggagttagctactaatagacctgtcctacaggaaatgcactacaagta

SEQ ID NO: 3952 - DNA, 951 bp, synthetic construct; identical to SEQ ID NO: 1109
  misc_feature 1..951: note = Synthetic polypeptide
  source 1..951: mol_type = other DNA

SEQ ID NO: 3953 - DNA, 1036 bp, synthetic construct; identical to SEQ ID NO: 1110
  misc_feature 1..1036: note = Synthetic polypeptide
  source 1..1036: mol_type = other DNA

SEQ ID NO: 3954 - DNA, 871 bp, synthetic construct; identical to SEQ ID NO: 1111
  misc_feature 1..871: note = Synthetic polypeptide
  source 1..871: mol_type = other DNA

SEQ ID NO: 3955 - DNA, 154 bp, synthetic construct; identical to SEQ ID NO: 2227
  misc_feature 1..154: note = Synthetic polypeptide
  source 1..154: mol_type = other DNA

SEQ ID NO: 3956 - DNA, 951 bp, synthetic construct; identical to SEQ ID NO: 1127
  misc_feature 1..951: note = Synthetic polypeptide
  source 1..951: mol_type = other DNA

SEQ ID NO: 3957 - DNA, 1036 bp, synthetic construct; identical to SEQ ID NO: 1128
  misc_feature 1..1036: note = Synthetic polypeptide
  source 1..1036: mol_type = other DNA

SEQ ID NO: 3958 - DNA, 871 bp, synthetic construct; identical to SEQ ID NO: 1129
  misc_feature 1..871: note = Synthetic polypeptide
  source 1..871: mol_type = other DNA

SEQ ID NO: 3959 - DNA, 133 bp, synthetic construct; identical to SEQ ID NO: 1689
  misc_feature 1..133: note = Synthetic polypeptide
  source 1..133: mol_type = other DNA

SEQ ID NO: 3960 - DNA, 874 bp, synthetic construct; identical to SEQ ID NO: 1690
  misc_feature 1..874: note = Synthetic polypeptide
  source 1..874: mol_type = other DNA

SEQ ID NO: 3961 - DNA, 961 bp, synthetic construct; identical to SEQ ID NO: 1691
  misc_feature 1..961: note = Synthetic polypeptide
  source 1..961: mol_type = other DNA

SEQ ID NO: 3962 - DNA, 520 bp, synthetic construct; identical to SEQ ID NO: 1692
  misc_feature 1..520: note = Synthetic polypeptide
  source 1..520: mol_type = other DNA

SEQ ID NO: 3963 - DNA, 277 bp, synthetic construct; identical to SEQ ID NO: 1693
  misc_feature 1..277: note = Synthetic polypeptide
  source 1..277: mol_type = other DNA

SEQ ID NO: 3964 - DNA, 465 bp, synthetic construct
  misc_feature 1..465: note = Synthetic polypeptide
  source 1..465: mol_type = other DNA
atggcttgggccgcgctcctcggcctcctggccgcactgttgctgctgctgctactgagccgccgccgcacgcggtgtggtcacatcacttactggctcctgctgcaaaccctccagtggatccctgccacgcgtggcataggagccggactcccaccttggccttggccctcgtggtccacaaagtcatctccagcatcatcgcctacgtctcgtccccacattctccactccagccacgctggctcctgctgtctcgaaaacctcaccgagcatgctcccaccccagtacctttgcacttgctgttgcctctgcctgtaacactcttctccctgcccctcccagagcactcccttcacatccttctggtctttgctcacgtggcatctcctgaggaggccctccttgaccaccttttgtaaaccagcccccctcactgtctcacaccaccctgttttcttttt

SEQ ID NO: 3965 - DNA, 999 bp, synthetic construct; identical to SEQ ID NO: 983
  misc_feature 1..999: note = Synthetic polypeptide
  source 1..999: mol_type = other DNA

SEQ ID NO: 3966 - DNA, 314 bp, synthetic construct
  misc_feature 1..314: note = Synthetic polypeptide
  source 1..314: mol_type = other DNA
atgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatgataaccagatgcaacgtgaagatctagactggaccctggtttgatgaaccagctgtaaaaacacatttctggaacaactggagaaaccggagta

SEQ ID NO: 3967 - DNA, 1157 bp, synthetic construct
  misc_feature 1..1157: note = Synthetic polypeptide
  source 1..1157: mol_type = other DNA
atgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatgataaccagatgcaacgtgaagatctagactggaccctggtttgatgaaccagctgtaaaaacacatttctggaacaactggagaaaccggagta

SEQ ID NO: 3968 - DNA, 1221 bp, synthetic construct; identical to SEQ ID NO: 122
  misc_feature 1..1221: note = Synthetic polypeptide
  source 1..1221: mol_type = other DNA

SEQ ID NO: 3969 - DNA, 767 bp, synthetic construct; identical to SEQ ID NO: 937
  misc_feature 1..767: note = Synthetic polypeptide
  source 1..767: mol_type = other DNA

SEQ ID NO: 3970 - DNA, 677 bp, synthetic construct; identical to SEQ ID NO: 938
  misc_feature 1..677: note = Synthetic polypeptide
  source 1..677: mol_type = other DNA

SEQ ID NO: 3971 - DNA, 316 bp, synthetic construct; identical to SEQ ID NO: 1815
  misc_feature 1..316: note = Synthetic polypeptide
  source 1..316: mol_type = other DNA

SEQ ID NO: 3972 - DNA, 806 bp, synthetic construct; identical to SEQ ID NO: 974
  misc_feature 1..806: note = Synthetic polypeptide
  source 1..806: mol_type = other DNA

SEQ ID NO: 3973 - DNA, 2867 bp, synthetic construct
  misc_feature 1..2867: note = Synthetic polypeptide
  source 1..2867: mol_type = other DNA
atggcttcctggacgagcccctggtgggtgctgatagggatggtcttcatgcactctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgcccacctctttattgaatcaaaaacacttcaaggaagcaaaggagaacacagctttaacagccccggcgtctttctcgtagaaaacacaacagtggaatttcagaggggctccgagaggcaaacttttaagattccaggacctctgatggctgatttcatcttcaagaccaggtacactgcagccaaagacagcgtggttcagttcttcttttaccagcccatcagtcatcagtggagacaaactgacttctttccctgcactgtgacgtgtggaggaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaagtgatggatttaaagagataatgccctatgaccacttccaacctcttcctcgctgggaacataatccttggactgcatgttccgtgtcctgtggaggagggattcagagacggagctttgtgtgtgtagaggaatccatgcatggagagatattgcaggtggaagaatggaagtgcatgtacgcacccaaacccaaggttatgcaaacttgtaatctgtttgattgccccaagtggattgccatggagtggtctcagtgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaagaaaaaagtccagtggaagcaaaattgccttggctgaaacaagcacaagaactagaagagaccagaatagcaacagaagaaccaacgttcattccagaaccctggtcagcctgcagtaccacgtgtgggccgggtgtgcaggtccgtgaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcgtgggaggccatcaagaagccatagcagtgtgcttacatatccagacccagcagacagtcaatgacagcttgtgtgatatggtccaccgtcctccagccatgagccaggcctgtaacacagagccctgtccccccaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaaggagcattcaatgcaagaggacaatggagcaggatctacacaattctaaagaaaagcaagcatgactcaaggatttcctcttcatcctgtgttcttcatgtagagagacagcagagaggcagtcagagaatactgtctgataagcccttgaaaaagctgtagggccaagatgagatacagagatgactcaaaacagagaatccaggaatgcatagatcctggtaaaaaaggtgggagatgagtaataaattcatttgtgtaggattaagactaatcaactaacaattatattatagaacataacataaatatcagaaatcttgacattatctaaataataaaatgaaaactaattgagatttggagagatgaggtaga

SEQ ID NO: 3974 - DNA, 1107 bp, synthetic construct
  misc_feature 1..1107: note = Synthetic polypeptide
  source 1..1107: mol_type = other DNA
atgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaatctttataacctggcttcactggaactgagagagaatcttcttacatatcttcctgactctcttacccagctgcgaagactagaagaacttgatttaggaaacaatgaaatatataatttgccagaatcaattggagccctcttacatctaaaagatctctggttggatggaaatcaactgtcagaattacctcaggaaataggaaatctgaagaacctgctgtgtttagatgtctctgaaaacaggttggaaagacttcctgaagaaatcagtggcctgacttcattaacggatttagtcatttcccagaacttattagaaacgattccggatggcattggaaaactaaagaaactgtcaatcttgaaggtggatcagaatagactcacacagttgcctgaagcagttggggaatgtgaaagtctcactgagttagttcttacagaaaatcagctcctgaccctgcctaaaagcattggaaaactaaagaagttgagcaacttgaatgcagacagaaataaattagtgtccttaccaaaagagatcggcgggtgctgcagcctcactgtgttctgtgtacgtgacaacagactaactcggatacctgcagaggtgtcacaggcaacagaacttcatgtcctggatgtggcagggaacagg

SEQ ID NO: 3975 - DNA, 117 bp, synthetic construct; identical to SEQ ID NO: 928
  misc_feature 1..117: note = Synthetic polypeptide
  source 1..117: mol_type = other DNA

SEQ ID NO: 3976 - DNA, 51 bp, synthetic construct; identical to SEQ ID NO: 929
  misc_feature 1..51: note = Synthetic polypeptide
  source 1..51: mol_type = other DNA

SEQ ID NO: 3977 - DNA, 816 bp, synthetic construct; identical to SEQ ID NO: 2923
  misc_feature 1..816: note = Synthetic polypeptide
  source 1..816: mol_type = other DNA

SEQ ID NO: 3978 - DNA, 769 bp, synthetic construct; identical to SEQ ID NO: 2924
  misc_feature 1..769: note = Synthetic polypeptide
  source 1..769: mol_type = other DNA

SEQ ID NO: 3979 - DNA, 720 bp, synthetic construct; identical to SEQ ID NO: 2925
  misc_feature 1..720: note = Synthetic polypeptide
  source 1..720: mol_type = other DNA

SEQ ID NO: 3980 - DNA, 169 bp, synthetic construct
  misc_feature 1..169: note = Synthetic polypeptide
  source 1..169: mol_type = other DNA
atgaaccaactcagcttcctgctgtttctcatagcgaccaccagaggatggagtacaggcctttggatatgctgttttccctgccttggattggcttcctactgataaatcatgtttattctctcagaataagctaagatgtcacctggactggaaggtcttctgtgac

SEQ ID NO: 3981 - DNA, 3992 bp, synthetic construct; identical to SEQ ID NO: 120
  misc_feature 1..3992: note = Synthetic polypeptide
  source 1..3992: mol_type = other DNA

SEQ ID NO: 3982 - DNA, 3845 bp, synthetic construct; identical to SEQ ID NO: 121
  misc_feature 1..3845: note = Synthetic polypeptide
  source 1..3845: mol_type = other DNA

SEQ ID NO: 3983 - DNA, 4039 bp, synthetic construct; identical to SEQ ID NO: 2238
  misc_feature 1..4039: note = Synthetic polypeptide
  source 1..4039: mol_type = other DNA

SEQ ID NO: 3984 - DNA, 1587 bp, synthetic construct
  misc_feature 1..1587: note = Synthetic polypeptide
  source 1..1587: mol_type = other DNA
atgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggaaacagaaacttggatctgcaagaaggagtggagagcagcagaagtggtaaattagaacgtaaatattaaaatgcatggatttttttctctctgaattctcttgagagacaactgactattgtaagggaagattattttaagactattttaagataagactggagattggatttataatgtgtcaagttgatatgacaacaagagcaccagggatag

SEQ ID NO: 3985 - DNA, 200 bp, synthetic construct; identical to SEQ ID NO: 3254
  misc_feature 1..200: note = Synthetic polypeptide
  source 1..200: mol_type = other DNA

SEQ ID NO: 3986 - DNA, 1043 bp, synthetic construct; identical to SEQ ID NO: 3255
  misc_feature 1..1043: note = Synthetic polypeptide
  source 1..1043: mol_type = other DNA

SEQ ID NO: 3987 - DNA, 1743 bp, synthetic construct; identical to SEQ ID NO: 1253
  misc_feature 1..1743: note = Synthetic polypeptide
  source 1..1743: mol_type = other DNA

SEQ ID NO: 3988 - DNA, 1518 bp, synthetic construct; identical to SEQ ID NO: 1254
  misc_feature 1..1518: note = Synthetic polypeptide
  source 1..1518: mol_type = other DNA

SEQ ID NO: 3989 - DNA, 1767 bp, synthetic construct; identical to SEQ ID NO: 1255
  misc_feature 1..1767: note = Synthetic polypeptide
  source 1..1767: mol_type = other DNA

SEQ ID NO: 3990 - DNA, 4932 bp, synthetic construct
  misc_feature 1..4932: note = Synthetic polypeptide
  source 1..4932: mol_type = other DNA
atgcccggcggccccagtccccgcagccccgcgcctttgctgcgccccctcctcctgctcctctgcgctctggctcccggcgcccccggacccgcaccaggacgtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagttttggcattcagcatgacggaagcggcaatgactgtgagcccgttgggaaacgacctttcatcatgtctccacagctcctgtacgacgccgctcccctcacctggtcccgctgcagccgccagtatatcaccaggttccttgaccgtgggtggggcctgtgcctggacgaccctcctgccaaggacattatcgacttcccctcggtgccacctggcgtcctctatgatgtaagccaccagtgccgcctccagtacggggcctactctgccttctgcgaggacatggataatgtctgccacacactctggtgctctgtggggaccacctgtcactccaagctggatgcagctgtggacggcacccggtgtggggagaataagtggtgtctcagtggggagtgcgtacccgtgggcttccggcccgaggccgtggatggtggctggtctggctggagcgcctggtccatctgctcacggagctgtggcatgggcgtacagagcgccgagcggcagtgcacgcagcctacgcccaaatacaaaggcagatactgtgtgggtgagcgcaagcgcttccgcctctgcaacctgcaggcctgccctgctggccgcccctccttccgccacgtccagtgcagccactttgacgctatgctctacaagggccagctgcacacatgggtgcccgtggtcaatgacgtgaacccctgcgagctgcactgccggcccgcgaatgagtactttgccgagaagctgcgggacgccgtggtcgatggcaccccctgctaccaggtccgagccagccgggacctctgcatcaacggcatctgtaagaacgtgggctgtgacttcgagattgactccggtgctatggaggaccgctgtggtgtgtgccacggcaacggctccacctgccacaccgtgagcgggaccttcgaggaggccgagggcctggggtatgtggatgtggggctgatcccagcgggcgcacgcgagatccgcatccaagaggttgccgaggctgccaacttcctggcactgcggagcgaggacccggagaagtacttcctcaatggtggctggaccatccagtggaacggggactaccaggtggcagggaccaccttcacatacgcacgcaggggcaactgggagaacctcacgtccccgggtcccaccaaggagcctgtctggatccagctgctgttccaggagagcaaccctggggtgcactacgagtacaccatccacagggaggcaggtggccacgacgaggtcccgccgcccgtgttctcctggcattatgggccctggaccaagtgcacagtcacctgcggcagaggtgtgcagaggcagaatgtgtactgcttggagcggcaggcagggcccgtggacgaggagcactgtgaccccctgggccggcctgatgaccaacagaggaagtgcagcgagcagccctgccctgccaggtggtgggcaggtgagtggcagctgtgctccagctcctgcgggcctgggggcctctcccgccgggccgtgctctgcatccgcagcgtggggctggatgagcagagcgccctggagccacccgcctgtgaacaccttccccggccccctactgaaaccccttgcaaccgccatgtaccctgtccggccacctgggctgtggggaactggtctcagtgctcagtgacatgtggggagggcactcagcgccgaaatgtcctctgcaccaatgacaccggtgtcccctgtgacgaggcccagcagccagccagcgaagtcacctgctctctgccactctgtcggtggcccctgggcacactgggccctgaaggctcaggcagcggctcctccagccacgagctcttcaacgaggctgacttcatcccgcaccacctggccccacgcccttcacccgcctcatcacccaagccaggcaccatgggcaacgccattgaggaggaggctccagagctggacctgccggggcccgtgtttgtggacgacttctactacgactacaatttcatcaatttccacgaggatctgtcctacgggccctctgaggagcccgatctagacctggcggggacaggggaccggacacccccaccacacagccatcctgctgcgccctccacgggtagccccgtgcctgccacagagcctcctgcagccaaggaggagggggtactgggaccttggtccccgagcccttggcctagccaggccggccgctccccacccccaccctcagagcagacccctgggaaccctttgatcaatttcctgcctgaggaagacacccccataggggccccagatcttgggctccccagcctgtcctggcccagggtttccactgatggcctgcagacacctgccacccctgagagccaaaatgatttcccagttggcaaggacagccagagccagctgccccctccatggcgggacaggaccaatgaggttttcaaggatgatgaggaacccaagggccgaggagcaccccacctgcccccgagacccagctccacgctgccccctttgtcccctgttggcagcacccactcctctcctagtcctgacgtggcggagctgtggacaggaggcacagtggcctgggagccagctctggagggtggcctggggcctgtggacagtgaactgtggcccactgttggggtggcttctctccttcctcctcccatagcccctctgccagagatgaaggtcagggacagttccctggagccggggactccctccttcccaaccccaggaccaggctcatgggacctgcagactgtggcagtgtgggggaccttcctccccacaaccctgactggcctcgggcacatgcctgagcctgccctgaacccaggacccaagggtcagcctgagtccctcagccctgaggtgcccctgagctctaggctgctgtccacaccagcttgggacagccccgccaacagccacagagtccctgagacccagccgctggctcccagcctggctgaagcggggccccccgcggacccgttggttgtcaggaacgccggctggcaagcgggaaactggagcgagtgctctaccacctgtggcctgggtgcggtctggaggccggtgcgctgtagctccggccgggatgaggactgcgcccccgctggccggccccagcctgcccgccgctgccacctgcggccctgtgccacctggcactcaggcaactggagtaagtgctcccgcagctgcggcggaggttcctcagtgcgggacgtgcagtgtgtggacacacgggacctccggccactgcggcccttccattgtcagcccgggcctgccaagccgcctgcgcaccggccctgcggggcccagccctgcctcagctggtacacatcttcctggagggagtgctccgaggcctgtggcggtggtgagcagcagcgtctagtgacctgcccggagccaggcctctgcgaggaggcgctgagacccaacaccacccggccctgcaacacccacccctgcacgcagtgggtggtggggccctggggccagtgctcaggcccctgtggtggtggtgtccagcggcgcctggtcaagtgtgtcaacacccagacagggctgcccgaggaagacagtgaccagtgtggccacgaggcctggcctgagagctcccggccgtgtggcaccgaggattgtgagcccgtcgagcctccccgtctcagtcttcccacagtgagaccaggg

SEQ ID NO: 3991 - DNA, 5237 bp, synthetic construct
  misc_feature 1..5237: note = Synthetic polypeptide
  source 1..5237: mol_type = other DNA
atgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgctgcggctgcttcgagtcatggagcatgtgcagaccaccctcctgctgggaaaactgccagggggccttccagccatgctggccaccccctccatctctgtgtacacaaacagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccagacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgtccaatgccatcaacatccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatcccgacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcgataaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcctaggccctcaggcagctgcagaccctgaagggcggcctgggggtacagccgggcacctgggcccctgcacatgccagcgctcttcaggtgagcaaaccccctcaaggcctgccctggtggtgcatcctggtgggctggctcctggtagcggccaccagtggcgtggcggccttcttcaccatgctctacggcctgcactacgggagggccagctccctcaggtggctcatctccatggctgtctccttcgtggagagcatgttcgtcacccagcccctgaaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccaggctttatcactgatgggaactccaagctggttggcagtgcccagattcgtcaagtgagggtccaggaaagctcttgccctcttgcccagcagccgcaggcatatctcaacggatgccgtgcaccatattccctggatgctgaagacatggcagactatggggaaggctggaatgccaccaccctcagtaatggcagtaccagagccaggaccaacgtcaagggtatcccatctggggcaaactcactgtgtaccggggaggaggctacgtggtccccttggggactgatcgccaaagcacgtcaagaattctccgctatctctttgacaacacctggctggacgccctgaccagagctgtgtttgtggagtccactgtctacaacgccaacgtcaacctgttctgcattgtcacgctgacgctagagaccagcgctctgggcaccttttttacgcacgcggccctgcagagcctccgcctgtaccccttcaccgacggctggcaccccttcgtggtagcggcagagctcatctacttcctcttcctcctctactacatggtggtgcagggcaagcgcatgagtaaagagacgtggggctatttctgcagcaagtggaaccttctggagctggccatcatcctggccagctggagcgccctggcggtgtttgtgaagagggctgtcctggccgaaagggacctccagcgctgccggaaccacagggaggaaggcatcagcttcagtgagacagcagcagccgatgccgcccttggctacatcattgccttcctggtactcctgtccacagtgaagctttggcatctgctcaggttgaatcccaaaatgaacatgatcacggcagccctacgccgtgcctggggcgacatttcaggctttatgattgtcatccttaccatgctcctggcttactccatcgcgtcaaacttgatatttggttggaaactccgttcctacaaaaccctctttgatgcggcggagacgatggtcagccttcagctgggaatcttcaactacgaggaggtcctggactatagcccagtgcttggctccttcctcattggatcctgcattgtttttatgacatttgtggtgctgaacctgtttatctctgtcatcctggtggccttcagtgaggagcaaaaatactatcagtgacctccaccctgagtgcaccttagaatcacctggggccttttggaaacaacggctgcccagccagagaccaat

SEQ ID NO: 3992 - DNA, 7292 bp, synthetic construct
  misc_feature 1..7292: note = Synthetic polypeptide
  source 1..7292: mol_type = other DNA
atgagtgcagtgggcttggtactcctggtgcttgctctgaggcttagggccaccactgttaagccagaggaaggcagcttttgctctaacagccaggtggccttcagagatgcttgctatgaatttgtgccactcggacgcaccttccgtgatgcccagagctggtgcgaggggcaaggaggccatttggtcttcattcaggacgaaggcacccagtggtttctgcagaagcacatctcccaggacagggaatggtggattggactcacgtggaacttggcacggaatggaaccacggaggggccggggacttggttggacacctccaatgtgacctacagcaactggcatggagggcaggccgccgctgcccctgacacctgcggccacatcgggagaggcccttcctctgagtgggtgacctcggactgcgcccagaccttcgccttcatgtgcgagttccgggttggccagagcctggcctgcgagggactcaatgccaccgtgcactgtggcttggggcaggtcatccaggtccaggatgccgtctacgggcgccagaatccccatttctgcacccaggatgccgggcgtccttcagatctggagcagggatgcagctgggccaacgtcaaggaggaggtggcaggccagtgccaggagctacagtcatgccaggtggcagcagatgagacctactttggaaacctgtgtccgactcagggcagttacctgtgggtgcagtaccagtgccgggaagccctgcagctgatggtgtccagtgagagtttcatctttgacaatgtcaccatctccctgacgtggctcctctcaccctacataggaaacctgtcctgtataattagtacaggagacagccacacttttgatccctacaacccgccgagtgtgtccagcaatgtgacccaccagttcacatctcctggggaattcaccgtgtttgctgaatgcacaaccagtgagtggcatgtgacagctcagaggcaggtgaccgtgcgagacaagatggagacgctcagtgtgactgcatgctccggcctgtcccagtcaggagccggccctctctgccaggctgtctttggggatcctctgtggattcaggtggagcttgatggaggaacaggagtgacttacactgtgcttttgggtgacataaccctggccgagtccaccacccaaaagggctcgctaccgtacaatctgatcctggacagagaaacccagaaactgatgggccctgggaggcaccgcctggagatccaagccaccggcaacaccaccacctctacaatctccagaaacattacagtccacttggtggagctgctgtcagggctgcaggcctcctgggcttctgaccatttggagcttggacaggacctattgatcaccatctcattggctcagggcaccccggaagagctgacctttgaggtggctggactcaatgcaaccttctcccacgagcaagtgagctttggagagccatttgggatttgccgcctggctgttccggttgaaggcacctttctggtcaccatgctggtgaggaatgccttctccaacctgagtttggaaatcgggaacatcactatcacagccccttccggtctccaagaaccatctgggatgaatgctgaaggaaagagtaaagataaaggcgatatggaggtgtacatccaacctggtccatatgtggatcctttcacgacagtgaccctgggctggccagacaatgacaaggagttacgcttccaatggtcatgtgggtcttgctgggctctgtggagcagctgtgttgagaggcagctgcttcgcacagaccagagggagctggtggttccagcatcctgcctgccgccgcctgactctgctgtcaccctgcgcctggctgttctgagaggccaagagctggagaacagggcagagcagtgcctctacgtgtctgcgccctgggaactcaggcctcgagtcagctgtgagaggaactgcaggccagttaatgccagcaaagacattctgctcagggtcaccatgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccagtgggaggccagcttggctctacagcatgccagtgaggccctgttgacagtgagtgccaaggcccgccctgaggaccagaggcgccaggcagccaccagggacctgtttcaggctgtgggcagtgtgctggaagcttccctgagcaacagaccagaagagcctgcggaggccagcagcagccagattgccacagtgctgcggctgcttcgagtcatggagcatgtgcagaccaccctcctgctgggaaaactgccagggggccttccagccatgctggccaccccctccatctctgtgtacacaaacagaatacaaccctggagttggcaaggctcctccctgcgccctgatgccgcagactctgcaaccttcatgctgcccgctgcctcctccctcagctctctggagggcggccaggagcccgtggatataaagatcatgagtttcccaaagagcccctttccagcccgaagccactttgatgtcagcgggactgtcggtggcctccgtgtgaccagccctagtggtcaactcatacctgtgaagaatctgtcggagaatatcgagatcctgctgccccggcattcacaaagacacagccagccgaccgtgttgaacctgaccagtcctgaagctttgtgggtgaacgtgacttcaggggaggcaaccttggggatccagctgcactggagaccagacattgcactcacgcttagcctgggctatggctaccaccccaacaagagcagctacgatgcccaaactcacctcgtaccaatggtggctccagatgagctgcccacgtggatcctgagcccacaggacctgcgttttggagaaggggtctactatttgactgtggtccctgagtctgacctggagccagcccccggcagggacctcacggttggcatcaccaccttcctgtctcactgtgtgttctgggatgaggtccaggagacttgggacgactcaggatgccaggtggggcctcggaccagcccctaccagacacactgcctctgcaaccacctcactttcttcggaagcacgttcctggtgatgtccaatgccatcaacatccaccagactgctgagctctttgccacctttgaggacaaccctgtggtcgtgaccaccgtgggctgcctgtgtgtggtctacgtgctggtggtgatctgggcgaggaggaaggacgctcaggatcaggccaaggtgaaggtcacagtgctggaagacaatgatccctttgctcagtaccactacctggtgacagtctacacaggacaccgacgaggggcagccacgtcctcaaaggtgactgtcaccctgtatggcctggatggagagagagagccccaccacctggctgatcccgacactccggtttttgagcgaggagcagtggatgccttcctcctctccaccctgttccccctgggagaactgcggagcctccggctgtggcatgacaactcaggggaccggccatcgtggtatgtgagccgggtgctggtctatgacctggtgatggaccggaagtggtatttcctgtgcaactcctggctatccatcaatgttggagattgcgtcctcgataaggtgtttcctgtggccacggagcaggacagaaaacaattcagccacctgtttttcatgaagacttccgcgggcttccaggatggacacatctggtattcgatcttcagccgctgcgctcgcagcagcttcacccgcgtccagagggtgtcctgctgcttctccctgctgctgtgcaccatgctgaccagcatcatgttctggggggtccccaaggacccagctgagcaaaagatggacttgggtaaaattgaattcacctggcaggaggtgatgattggcctggagagctccatcctcatgttccccatcaacctcctgattgttcagatctttcagaacacccgtccccgggtcgcgaaggagcagaacactggaaaatgggaccgggggtcccccaacctgactccctccccacagcccatggaggacggccttctgacacctgaggcagtgaccaaggatgtgtcaagaatcgtcagctccctcttcaaagctctcaaggtgccatcccccgccttgggctgggactcagtgaacttgatggacatcaacagtctcctcgccttggtggaagatgtcatttatccacagaacacatcagggcaggtgttctgggaggaagccaaaaagagagaggaccctgtaacactcactttggggtcatcagaaatgaaagagaaatcacagtgtcccaagcccaaggcggcacggagtggcccctggaaggacagcgcctacaggcagtgtctgtaccttcagctggaacacgtggagcaagagctgcggctggtggggccccgaggcttctcccagccccacagccatgcctaggccctcaggcagctgcagaccctgaagggcggcctgggggtacagccgggcacctgggcccctgcacatgccagcgctcttcaggtgagcaaaccccctcaaggcctgccctggtggtgcatcctggtgggctggctcctggtagcggccaccagtggcgtggcggccttcttcaccatgctctacggcctgcactacgggagggccagctccctcaggtggctcatctccatggctgtctccttcgtggagagcatgttcgtcacccagcccctgaaggtgctgggattcgctgctttctttgcactggtcttgaagagagtggacgatgaggaggatactgtggccccgctgccaggacatctgttgggcccagacccctatgccttgttccgagcacgaagaaacagcagcagggatgtctaccagccacctctcaccgctgccattgagaagatgaaaaccacccacctcaaggaacagaaagcatttgccctcatcagagaaatcctggcatacttgggcttcctgtggatgctactgctcgtggcctacgggcagagggaccccagcgcctaccacctcaacagacacctccagcacagcttcaccaggggcttttcaggtgtgctcggcttccgagagttcttcaagtgggccaacaccaccctcgtgagtaacctgtatggtcaccccccaggctttatcactgatgggaactccaagctggttggcagtgcccagattcgtcaagtgagggtccaggaaagctcttgccctcttgcccagcagccgcaggcatatctcaacggatgccgtgcaccatattccctggatgctgaagacatggcagactatggggaaggctggaatgccaccaccctcagtaatggcagtaccagagccaggaccaacgtcaagggtatcccatctggggcaaactcactgtgtaccggggaggaggctacgtggtccccttggggactgatcgccaaagcacgtcaagaattctccgctatctctttgacaacacctggctggacgccctgaccagagctgtgtttgtggagtccactgtctacaacgccaacgtcaacctgttctgcattgtcacgctgacgctagagaccagcgctctgggcaccttttttacgcacgcggccctgcagagcctccgcctgtaccccttcaccgacggctggcaccccttcgtggtagcggcagagctcatctacttcctcttcctcctctactacatggtggtgcagggcaagcgcatgagtaaagagacgtggggctatttctgcagcaagtggaaccttctggagctggccatcatcctggccagctggagcgccctggcggtgtttgtgaagagggctgtcctggccgaaagggacctccagcgctgccggaaccacagggaggaaggcatcagcttcagtgagacagcagcagccgatgccgcccttggctacatcattgccttcctggtactcctgtccacagtgaagctttggcatctgctcaggttgaatcccaaaatgaacatgatcacggcagccctacgccgtgcctggggcgacatttcaggctttatgattgtcatccttaccatgctcctggcttactccatcgcgtcaaacttgatatttggttggaaactccgttcctacaaaaccctctttgatgcggcggagacgatggtcagccttcagctgggaatcttcaactacgaggaggtcctggactatagcccagtgcttggctccttcctcattggatcctgcattgtttttatgacatttgtggtgctgaacctgtttatctctgtcatcctggtggccttcagtgaggagcaaaaatactatcagtgacctccaccctgagtgcaccttagaatcacctggggccttttggaaacaacggctgcccagccagagaccaat

SEQ ID NO: 3993 - DNA, 235 bp, synthetic construct; identical to SEQ ID NO: 1657
  misc_feature 1..235: note = Synthetic polypeptide
  source 1..235: mol_type = other DNA

SEQ ID NO: 3994 - DNA, 1078 bp, synthetic construct; identical to SEQ ID NO: 1658
  misc_feature 1..1078: note = Synthetic polypeptide
  source 1..1078: mol_type = other DNA

SEQ ID NO: 3995 - DNA, 303 bp, synthetic construct; identical to SEQ ID NO: 148
  misc_feature 1..303: note = Synthetic polypeptide
  source 1..303: mol_type = other DNA

SEQ ID NO: 3996 - DNA, 301 bp, synthetic construct; identical to SEQ ID NO: 147
  misc_feature 1..301: note = Synthetic polypeptide
  source 1..301: mol_type = other DNA

SEQ ID NO: 3997 - DNA, 1052 bp, synthetic construct; identical to SEQ ID NO: 247
  misc_feature 1..1052: note = Synthetic polypeptide
  source 1..1052: mol_type = other DNA

SEQ ID NO: 3998 - DNA, 327 bp, synthetic construct; identical to SEQ ID NO: 246
  misc_feature 1..327: note = Synthetic polypeptide
  source 1..327: mol_type = other DNA

SEQ ID NO: 3999 - DNA, 1284 bp, synthetic construct; identical to SEQ ID NO: 2536
  misc_feature 1..1284: note = Synthetic polypeptide
  source 1..1284: mol_type = other DNA

SEQ ID NO: 4000 - DNA, 1576 bp, synthetic construct
  misc_feature 1..1576: note = Synthetic polypeptide
  source 1..1576: mol_type = other DNA
atggcagcggccgccagccccgcgttccttctacgcctcccgcttctgctcctgctgtccagctggtgcaggaccgggctggccgaccctcactctctttgctatgacatcaccgtcatccctaagttcagacctggaccacggtggtgtgcggttcaaggccaggtggatgaaaagacttttcttcactatgactgtggcagcaagacagtcacacccgtcagtcccctggggaagaaactaaatgtcacaacggcctggaaagcacagaacccagtactgagagaggtggtggacatacttacagagcaactgcttgacattcagctggagaattacatacccaaggaacccctcaccctgcaggccaggatgtcttgtgagcagaaagccgaaggacacggcagtggatcttggcagctcagtttcgatggacagatcttcctcctctttgactcagaaaacagaatgtggacaacggttcatcctggagccagaaagatgaaagaaaagtgggagaatgacaaggatatgaccatgtccttccattacatctcaatgggagactgcacaggatggcttgaggacttcttgatgggcatggacagcaccctggagccaagtgcaggagcaccacccaccatgtcctcaggcacagcccaacccagggccacggccaccaccctcatcctttgctgcctcctcatcatgtgtctcctcatatgctccaggcacagtctgacccaaagccatggccaccaccctcagtccctgcagcctcctcctcatcctcccctgcttcatcctacctggctgctgaggagagtcctttggagtgacaggaaaaaccaggccatgcagagacaggagctgaagggacacggtgagaagtgaccagaagacaagagtgtgagccctctgtcatgcccagacagggccagtagtgggctcctcagtctagcagtagcgccagtgcctgggaaggcacttgttacttagcagaccgggaaaaggagtttccctttccccgggggagttagagaagactctgctccaccacctcttgtggaaggcctgacatcagtcaagcctgcccgcagccatccggaggcctaaacgtctccctgtgatgctgtgcttcagggtcacgctcctggtccactttcatgttccgccctgtacacctggctccgccttctagatagcggtagcagaattagtgaaagtattgaagtccgagaaatacatagaagaaacaatgacgtaagctgtcctctctctctccgcctcagctaccaaatagcgaagcgccccttgtctggtggacacgtgactcgcgtgactttacctatcattggagacgactcacactccttaccctgccctcttgccttgtatacaataaataacggcgcagccaggtattcggagccactacaggtctccatatcttgatggttccctgggcccagctgtcttttcttccgtctctttgtcttgtgtctttatttctacgatctctcatctccgcacacgaagagaaaaacccacaggccctgtagggctggtccctaca

SEQ ID NO: 4001 - DNA, 219 bp, synthetic construct
  misc_feature 1..219: note = Synthetic polypeptide
  source 1..219: mol_type = other DNA
atggcctggtggaaatcctggaagaatgaataaacagactaggttgaatccatacaatggaatgttagcagacaataaaaagaaaatgaactactgatgccccctactgcacagcagaagctctgaatcgtgttcctgaatgaaagaagtcaggtatgaaagaataaacattgtatgattccatttatatgaaaatgaatctgtgatttaaaaatcaga

SEQ ID NO: 4002 - DNA, 154 bp, synthetic construct; identical to SEQ ID NO: 2227
  misc_feature 1..154: note = Synthetic polypeptide
  source 1..154: mol_type = other DNA

SEQ ID NO: 4003 - DNA, 1838 bp, synthetic construct; identical to SEQ ID NO: 2152
  misc_feature 1..1838: note = Synthetic polypeptide
  source 1..1838: mol_type = other DNA

SEQ ID NO: 4004 - DNA, 1146 bp, synthetic construct; identical to SEQ ID NO: 988
  misc_feature 1..1146: note = Synthetic polypeptide
  source 1..1146: mol_type = other DNA

SEQ ID NO: 4005 - DNA, 1058 bp, synthetic construct; identical to SEQ ID NO: 1966
  misc_feature 1..1058: note = Synthetic polypeptide
  source 1..1058: mol_type = other DNA

SEQ ID NO: 4006 - DNA, 1273 bp, synthetic construct; identical to SEQ ID NO: 1927
  misc_feature 1..1273: note = Synthetic polypeptide
  source 1..1273: mol_type = other DNA

SEQ ID NO: 4007 - DNA, 1516 bp, synthetic construct; identical to SEQ ID NO: 1928
  misc_feature 1..1516: note = Synthetic polypeptide
  source 1..1516: mol_type = other DNA

SEQ ID NO: 4008 - DNA, 1393 bp, synthetic construct; identical to SEQ ID NO: 1929
  misc_feature 1..1393: note = Synthetic polypeptide
  source 1..1393: mol_type = other DNA

SEQ ID NO: 4009 - DNA, 117 bp, synthetic construct; identical to SEQ ID NO: 928
  misc_feature 1..117: note = Synthetic polypeptide
  source 1..117: mol_type = other DNA

SEQ ID NO: 4010 - DNA, 51 bp, synthetic construct; identical to SEQ ID NO: 929
  misc_feature 1..51: note = Synthetic polypeptide
  source 1..51: mol_type = other DNA

SEQ ID NO: 4011 - DNA, 128 bp, synthetic construct; identical to SEQ ID NO: 144
  misc_feature 1..128: note = Synthetic polypeptide
  source 1..128: mol_type = other DNA

SEQ ID NO: 4012 - DNA, 458 bp, synthetic construct
  misc_feature 1..458: note = Synthetic polypeptide
  source 1..458: mol_type = other DNA
cccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4013 - DNA, 467 bp, synthetic construct
  misc_feature 1..467: note = Synthetic polypeptide
  source 1..467: mol_type = other DNA
acatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4014 - DNA, 7473 bp, synthetic construct
  misc_feature 1..7473: note = Synthetic polypeptide
  source 1..7473: mol_type = other DNA
atgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4015 - DNA, 7305 bp, synthetic construct
  misc_feature 1..7305: note = Synthetic polypeptide
  source 1..7305: mol_type = other DNA
atgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4016 - DNA, 7494 bp, synthetic construct
  misc_feature 1..7494: note = Synthetic polypeptide
  source 1..7494: mol_type = other DNA
atgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatcgtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4017 - DNA, 7308 bp, synthetic construct
  misc_feature 1..7308: note = Synthetic polypeptide
  source 1..7308: mol_type = other DNA
atgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4018 - DNA, 6156 bp, synthetic construct
  misc_feature 1..6156: note = Synthetic polypeptide
  source 1..6156: mol_type = other DNA
atgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4019 - DNA, 7443 bp, synthetic construct
  misc_feature 1..7443: note = Synthetic polypeptide
  source 1..7443: mol_type = other DNA
atgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4020 - DNA, 863 bp, synthetic construct
  misc_feature 1..863: note = Synthetic polypeptide
  source 1..863: mol_type = other DNA
tgactctgggcccccccacttgcctgcaggaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggcaactccacggtggatgagattttacctgtgttattcaccaacccgttcccagtacctggaagaatgttggacacatagtaggagttcagtaagtatttgttgagttaa

SEQ ID NO: 4021 - DNA, 190 bp, synthetic construct; identical to SEQ ID NO: 1996
  misc_feature 1..190: note = Synthetic polypeptide
  source 1..190: mol_type = other DNA

SEQ ID NO: 4022 - DNA, 1563 bp, synthetic construct; identical to SEQ ID NO: 2008
  misc_feature 1..1563: note = Synthetic polypeptide
  source 1..1563: mol_type = other DNA

SEQ ID NO: 4023 - DNA, 775 bp, synthetic construct; identical to SEQ ID NO: 1985
  misc_feature 1..775: note = Synthetic polypeptide
  source 1..775: mol_type = other DNA

SEQ ID NO: 4024 - DNA, 1845 bp, synthetic construct
  misc_feature 1..1845: note = Synthetic polypeptide
  source 1..1845: mol_type = other DNA
atgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctggggccgggcgcggtggctcacgcctgtaatcccagcactttgggaggccacggcgggcggatcacgaggtcaggagatggagaccatcctggctaacacggtgaaaccccgtctctactaaaaatacaaaaaattagccgggcgaggtggcgggcgcctgtagtcccagctacgtgggaggctgaggcaggagaatggtgtggacccgggaggcggagcctgcagtgagctgagatcacgccattgcactccagcctgggtgacagcgagactcggtctcaaaaaaaaataaataaataaaataaataaa

SEQ ID NO: 4025 - DNA, 1668 bp, synthetic construct
  misc_feature 1..1668: note = Synthetic polypeptide
  source 1..1668: mol_type = other DNA
atggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctggggccgggcgcggtggctcacgcctgtaatcccagcactttgggaggccacggcgggcggatcacgaggtcaggagatggagaccatcctggctaacacggtgaaaccccgtctctactaaaaatacaaaaaattagccgggcgaggtggcgggcgcctgtagtcccagctacgtgggaggctgaggcaggagaatggtgtggacccgggaggcggagcctgcagtgagctgagatcacgccattgcactccagcctgggtgacagcgagactcggtctcaaaaaaaaataaataaataaaataaataaa

SEQ ID NO: 4026 - DNA, 768 bp, synthetic construct
  misc_feature 1..768: note = Synthetic polypeptide
  source 1..768: mol_type = other DNA
atgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctggggccgggcgcggtggctcacgcctgtaatcccagcactttgggaggccacggcgggcggatcacgaggtcaggagatggagaccatcctggctaacacggtgaaaccccgtctctactaaaaatacaaaaaattagccgggcgaggtggcgggcgcctgtagtcccagctacgtgggaggctgaggcaggagaatggtgtggacccgggaggcggagcctgcagtgagctgagatcacgccattgcactccagcctgggtgacagcgagactcggtctcaaaaaaaaataaataaataaaataaataaa

SEQ ID NO: 4027 - DNA, 1737 bp, synthetic construct
  misc_feature 1..1737: note = Synthetic polypeptide
  source 1..1737: mol_type = other DNA
atgagcagtatcaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctggggccgggcgcggtggctcacgcctgtaatcccagcactttgggaggccacggcgggcggatcacgaggtcaggagatggagaccatcctggctaacacggtgaaaccccgtctctactaaaaatacaaaaaattagccgggcgaggtggcgggcgcctgtagtcccagctacgtgggaggctgaggcaggagaatggtgtggacccgggaggcggagcctgcagtgagctgagatcacgccattgcactccagcctgggtgacagcgagactcggtctcaaaaaaaaataaataaataaaataaataaa

SEQ ID NO: 4028 - DNA, 1663 bp, synthetic construct
  misc_feature 1..1663: note = Synthetic polypeptide
  source 1..1663: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgggg

SEQ ID NO: 4029 - DNA, 445 bp, synthetic construct
  misc_feature 1..445: note = Synthetic polypeptide
  source 1..445: mol_type = other DNA
atgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggcttggcacacagcaggctttcaagaagtgccagttgatcaatgaataaat

SEQ ID NO: 4030 - DNA, 385 bp, synthetic construct; identical to SEQ ID NO: 1938
  misc_feature 1..385: note = Synthetic polypeptide
  source 1..385: mol_type = other DNA

SEQ ID NO: 4031 - DNA, 696 bp, synthetic construct; identical to SEQ ID NO: 2305
  misc_feature 1..696: note = Synthetic polypeptide
  source 1..696: mol_type = other DNA

SEQ ID NO: 4032 - DNA, 323 bp, synthetic construct
  misc_feature 1..323: note = Synthetic polypeptide
  source 1..323: mol_type = other DNA
atggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccggcacagccggagccaactaataca

SEQ ID NO: 4033 - DNA, 692 bp, synthetic construct
  misc_feature 1..692: note = Synthetic polypeptide
  source 1..692: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatacaaaaattagctgggtgtgttggtgtgcaactgtaatcccagctgctcgggaggctgagacaggagaatcactcgaacccagaaggcagaggctacagtgagctaagatcacaccactgcactccagcctgggccacagagcaatactccgtctcaaaaaaaaaaaaaaaaagaagaagaaaaga

SEQ ID NO: 4034 - DNA, 629 bp, synthetic construct
  misc_feature 1..629: note = Synthetic polypeptide
  source 1..629: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttgtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatacaaaaattagctgggtgtgttggtgtgcaactgtaatcccagctgctcgggaggctgagacaggagaatcactcgaacccagaaggcagaggctacagtgagctaagatcacaccactgcactccagcctgggccacagagcaatactccgtctcaaaaaaaaaaaaaaaaagaagaagaaaaga

SEQ ID NO: 4035 - DNA, 534 bp, synthetic construct; identical to SEQ ID NO: 2415
  misc_feature 1..534: note = Synthetic polypeptide
  source 1..534: mol_type = other DNA

SEQ ID NO: 4036 - DNA, 542 bp, synthetic construct; identical to SEQ ID NO: 2416
  misc_feature 1..542: note = Synthetic polypeptide
  source 1..542: mol_type = other DNA

SEQ ID NO: 4037 - DNA, 1403 bp, synthetic construct; identical to SEQ ID NO: 2417
  misc_feature 1..1403: note = Synthetic polypeptide
  source 1..1403: mol_type = other DNA

SEQ ID NO: 4038 - DNA, 491 bp, synthetic construct; identical to SEQ ID NO: 2418
  misc_feature 1..491: note = Synthetic polypeptide
  source 1..491: mol_type = other DNA

SEQ ID NO: 4039 - DNA, 578 bp, synthetic construct; identical to SEQ ID NO: 2419
  misc_feature 1..578: note = Synthetic polypeptide
  source 1..578: mol_type = other DNA

SEQ ID NO: 4040 - DNA, 1280 bp, synthetic construct; identical to SEQ ID NO: 2420
  misc_feature 1..1280: note = Synthetic polypeptide
  source 1..1280: mol_type = other DNA

SEQ ID NO: 4041 - DNA, 1370 bp, synthetic construct; identical to SEQ ID NO: 2421
  misc_feature 1..1370: note = Synthetic polypeptide
  source 1..1370: mol_type = other DNA

SEQ ID NO: 4042 - DNA, 692 bp, synthetic construct; identical to SEQ ID NO: 2422
  misc_feature 1..692: note = Synthetic polypeptide
  source 1..692: mol_type = other DNA

SEQ ID NO: 4043 - DNA, 431 bp, synthetic construct; identical to SEQ ID NO: 2423
  misc_feature 1..431: note = Synthetic polypeptide
  source 1..431: mol_type = other DNA

SEQ ID NO: 4044 - DNA, 344 bp, synthetic construct; identical to SEQ ID NO: 2424
  misc_feature 1..344: note = Synthetic polypeptide
  source 1..344: mol_type = other DNA

SEQ ID NO: 4045 - DNA, 1553 bp, synthetic construct; identical to SEQ ID NO: 2425
  misc_feature 1..1553: note = Synthetic polypeptide
  source 1..1553: mol_type = other DNA

SEQ ID NO: 4046 - DNA, 1493 bp, synthetic construct; identical to SEQ ID NO: 2426
  misc_feature 1..1493: note = Synthetic polypeptide
  source 1..1493: mol_type = other DNA

SEQ ID NO: 4047 - DNA, 638 bp, synthetic construct; identical to SEQ ID NO: 2427
  misc_feature 1..638: note = Synthetic polypeptide
  source 1..638: mol_type = other DNA

SEQ ID NO: 4048 - DNA, 1439 bp, synthetic construct; identical to SEQ ID NO: 2428
  misc_feature 1..1439: note = Synthetic polypeptide
  source 1..1439: mol_type = other DNA

SEQ ID NO: 4049 - DNA, 1352 bp, synthetic construct; identical to SEQ ID NO: 2429
  misc_feature 1..1352: note = Synthetic polypeptide
  source 1..1352: mol_type = other DNA

SEQ ID NO: 4050 - DNA, 602 bp, synthetic construct; identical to SEQ ID NO: 2430
  misc_feature 1..602: note = Synthetic polypeptide
  source 1..602: mol_type = other DNA

SEQ ID NO: 4051 - DNA, 645 bp, synthetic construct
  misc_feature 1..645: note = Synthetic polypeptide
  source 1..645: mol_type = other DNA
atggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacaccatacaatttatatttatcaagtacaccaagaaagagaaccaagaggaaaaaaagacaatagaaacgggacatccctccactccacccccacaaacacacaggtaacttggttatcagacacagacttaaaaatggttgtgatcagtgcattcaagaaaatagaggacaagatggtaaattttattaaaaagaaactaagtggaaatcttagaactgaaaaatagaataatagagattaagaactcagtagatgggtttagtagcagactggactcagtagaatagag

SEQ ID NO: 4052 - DNA, 1262 bp, synthetic construct
  misc_feature 1..1262: note = Synthetic polypeptide
  source 1..1262: mol_type = other DNA
atgttcaggtccaaacgctcggggctggtgcggcgactttggcgaagtcgtgtggtccccgaccgggaggaaggcggcagcggcggcggcggtggcggcgacgaggatgggagcttgggcagccgagctgagccggccccgcgggcaagagagggcggaggctgcggccgctccgaagtccgcccggtagccccgcggcggccccgggacgcagtgggacagcgaggcgcccagggcgcggggaggcgccggcgcgcagggggccccccgaggcccatgtcggagccaggggccggcgctgggagctccctgctggacgtggcggagccgggaggcccgggctggctgcccgagagtgactgcgagacggtgacctgctgtctcttttcggagcgggacgccgccggcgcgccccgggacgccagcgaccccctggccggggcggccctggagccggcgggcggcgggcggagtcgcgaagcgcgctcgcggctgctgctgctggagcaggaactcaaaaccgtcacgtactcgctgctgaagcggctcaaggagcgctcgctggacacgctgctggaggcggtggagtcccgcggcggcgtgccgggcggctgcgtgctggtgccgcgcgccgacctccgcctgggcggccagcccgcgccgccgcagctgctgctcggccgcctctttcgctggcccgacctgcagcacgccgtggagctgaagcccctgtgcggctgccacagcttcgccgccgccgccgacggccctaccgtgtgctgcaacccctaccacttcagccggctctgcgggcccgccaaagagaggaagcaacccaaatgtccattagctgataaatggataaatgaaatatggtacgtccgaagaatggaatatcattcacccatgaaaaagaacgaagtccagcaccaaaacgtgctacaacatggatgaacttcgatgactttgtgccacatgaaagaagaagccagccacaaaaggccatatattgtatgaaatgaaatgtccagaatgggcaaacccatagagacacaaagtaagttagtggttgcccagggttttggggttggggtctagaaagtgactgccaatggggatggtgtttctttttgcgataaaaaaaatgtcttgtgtttagatggtggttgatggttgcacaacactgtgaatatactcaaaaaccactgaatggtatatttttaaaaaggatgaatcttagggtatgtgaattatatctcaat

SEQ ID NO: 4053 - DNA, 1081 bp, synthetic construct; identical to SEQ ID NO: 986
  misc_feature 1..1081: note = Synthetic polypeptide
  source 1..1081: mol_type = other DNA

SEQ ID NO: 4054 - DNA, 1054 bp, synthetic construct; identical to SEQ ID NO: 987
  misc_feature 1..1054: note = Synthetic polypeptide
  source 1..1054: mol_type = other DNA

SEQ ID NO: 4055 - DNA, 372 bp, synthetic construct; identical to SEQ ID NO: 1188
  misc_feature 1..372: note = Synthetic polypeptide
  source 1..372: mol_type = other DNA

SEQ ID NO: 4056 - DNA, 681 bp, synthetic construct; identical to SEQ ID NO: 1642
  misc_feature 1..681: note = Synthetic polypeptide
  source 1..681: mol_type = other DNA

SEQ ID NO: 4057 - DNA, 534 bp, synthetic construct; identical to SEQ ID NO: 1643
  misc_feature 1..534: note = Synthetic polypeptide
  source 1..534: mol_type = other DNA

SEQ ID NO: 4058 - DNA, 270 bp, synthetic construct; identical to SEQ ID NO: 1644
  misc_feature 1..270: note = Synthetic polypeptide
  source 1..270: mol_type = other DNA

SEQ ID NO: 4059 - DNA, 596 bp, synthetic construct; identical to SEQ ID NO: 1645
  misc_feature 1..596: note = Synthetic polypeptide
  source 1..596: mol_type = other DNA

SEQ ID NO: 4060 - DNA, 840 bp, synthetic construct; identical to SEQ ID NO: 1937
  misc_feature 1..840: note = Synthetic polypeptide
  source 1..840: mol_type = other DNA

SEQ ID NO: 4061 - DNA, 840 bp, synthetic construct; identical to SEQ ID NO: 1937
  misc_feature 1..840: note = Synthetic polypeptide
  source 1..840: mol_type = other DNA

SEQ ID NO: 4062 - DNA, 1587 bp, synthetic construct; identical to SEQ ID NO: 3984
  misc_feature 1..1587: note = Synthetic polypeptide
  source 1..1587: mol_type = other DNA

SEQ ID NO: 4063 - DNA, 840 bp, synthetic construct; identical to SEQ ID NO: 2402
  misc_feature 1..840: note = Synthetic polypeptide
  source 1..840: mol_type = other DNA

SEQ ID NO: 4064 - DNA, 671 bp, synthetic construct
  misc_feature 1..671: note = Synthetic polypeptide
  source 1..671: mol_type = other DNA
atgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctcgtgtagagactctatctctacacaaaacaaatattaaaaaaaaaaaaaaaa

SEQ ID NO: 4065 - DNA, 823 bp, synthetic construct; identical to SEQ ID NO: 1941
  misc_feature 1..823: note = Synthetic polypeptide
  source 1..823: mol_type = other DNA

SEQ ID NO: 4066 - DNA, 715 bp, synthetic construct; identical to SEQ ID NO: 1942
  misc_feature 1..715: note = Synthetic polypeptide
  source 1..715: mol_type = other DNA

SEQ ID NO: 4067 - DNA, 299 bp, synthetic construct; identical to SEQ ID NO: 1943
  misc_feature 1..299: note = Synthetic polypeptide
  source 1..299: mol_type = other DNA

SEQ ID NO: 4068 - DNA, 148 bp, synthetic construct; identical to SEQ ID NO: 1944
  misc_feature 1..148: note = Synthetic polypeptide
  source 1..148: mol_type = other DNA

SEQ ID NO: 4069 - DNA, 1705 bp, synthetic construct; identical to SEQ ID NO: 1989
  misc_feature 1..1705: note = Synthetic polypeptide
  source 1..1705: mol_type = other DNA

SEQ ID NO: 4070 - DNA, 343 bp, synthetic construct
  misc_feature 1..343: note = Synthetic polypeptide
  source 1..343: mol_type = other DNA
atgcgcatgcacacccggctctcccttccaggccctccccaccacgtgggcgcggcctaccctcccgcagggggtaatagaagcgagaacgccggatcctggggcggggctggagcttcgtcagttgaaccgctcgcgaggagggttgctagtggagaagcctggatctctgccctgaactccagactcatatcatggccgactcttctctctttggaagttcatctgacattcagacataaacttgtcccaaaccaatcttgcgatttcttcctttcaacctccaaacccagttgatgggacattcatcctgccaggtactaagatcaagaagcttggagtg

SEQ ID NO: 4071 - DNA, 466 bp, synthetic construct; identical to SEQ ID NO: 2137
  misc_feature 1..466: note = Synthetic polypeptide
  source 1..466: mol_type = other DNA

SEQ ID NO: 4072 - DNA, 534 bp, synthetic construct
  misc_feature 1..534: note = Synthetic polypeptide
  source 1..534: mol_type = other DNA
ccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgtttctcc

SEQ ID NO: 4073 - DNA, 543 bp, synthetic construct
  misc_feature 1..543: note = Synthetic polypeptide
  source 1..543: mol_type = other DNA
atggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgtttctcc

SEQ ID NO: 4074 - DNA, 822 bp, synthetic construct; identical to SEQ ID NO: 119
  misc_feature 1..822: note = Synthetic polypeptide
  source 1..822: mol_type = other DNA

SEQ ID NO: 4075 - DNA, 2721 bp, synthetic construct; identical to SEQ ID NO: 962
  misc_feature 1..2721: note = Synthetic polypeptide
  source 1..2721: mol_type = other DNA

SEQ ID NO: 4076 - DNA, 2549 bp, synthetic construct; identical to SEQ ID NO: 963
  misc_feature 1..2549: note = Synthetic polypeptide
  source 1..2549: mol_type = other DNA

SEQ ID NO: 4077 - DNA, 320 bp, synthetic construct
  misc_feature 1..320: note = Synthetic polypeptide
  source 1..320: mol_type = other DNA
atggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccggcaccggagccaactaataca

SEQ ID NO: 4078 - DNA, 2520 bp, synthetic construct
  misc_feature 1..2520: note = Synthetic polypeptide
  source 1..2520: mol_type = other DNA
atggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccagcccacccctgcacagcccctcctccttcccgcttttccccttctccctcct

SEQ ID NO: 4079 - DNA, 1128 bp, synthetic construct
  misc_feature 1..1128: note = Synthetic polypeptide
  source 1..1128: mol_type = other DNA
atgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccagcccacccctgcacagcccctcctccttcccgcttttccccttctccctcct

SEQ ID NO: 4080 - DNA, 70 bp, synthetic construct
  misc_feature 1..70: note = Synthetic polypeptide
  source 1..70: mol_type = other DNA
ggacgtgattggcctccagcccacccctgcacagcccctcctccttcccgcttttccccttctccctcct

SEQ ID NO: 4081 - DNA, 1273 bp, synthetic construct; identical to SEQ ID NO: 2173
  misc_feature 1..1273: note = Synthetic polypeptide
  source 1..1273: mol_type = other DNA

SEQ ID NO: 4082 - DNA, 369 bp, synthetic construct; identical to SEQ ID NO: 1672
  misc_feature 1..369: note = Synthetic polypeptide
  source 1..369: mol_type = other DNA

SEQ ID NO: 4083 - DNA, 410 bp, synthetic construct; identical to SEQ ID NO: 1673
  misc_feature 1..410: note = Synthetic polypeptide
  source 1..410: mol_type = other DNA

SEQ ID NO: 4084 - DNA, 582 bp, synthetic construct
  misc_feature 1..582: note = Synthetic polypeptide
  source 1..582: mol_type = other DNA
atggggcctgaaaggcatctgtcaggcgcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccagccaggtgtggtggcacatgcctgcagttccagctactcaggaagcttactggagttccagctactcaaggttggaggatcccttgcgcccaggagttcaagtctcccatgagctatgatcacaccaactgcactccagcctgaacaacaaaacaacactgtctctaaagataaaaa

SEQ ID NO: 4085 - DNA, 2362 bp, synthetic construct; identical to SEQ ID NO: 1664
  misc_feature 1..2362: note = Synthetic polypeptide
  source 1..2362: mol_type = other DNA

SEQ ID NO: 4086 - DNA, 2113 bp, synthetic construct; identical to SEQ ID NO: 1665
  misc_feature 1..2113: note = Synthetic polypeptide
  source 1..2113: mol_type = other DNA

SEQ ID NO: 4087 - DNA, 1399 bp, synthetic construct; identical to SEQ ID NO: 1666
  misc_feature 1..1399: note = Synthetic polypeptide
  source 1..1399: mol_type = other DNA

SEQ ID NO: 4088 - DNA, 2080 bp, synthetic construct; identical to SEQ ID NO: 1667
  misc_feature 1..2080: note = Synthetic polypeptide
  source 1..2080: mol_type = other DNA

SEQ ID NO: 4089 - DNA, 575 bp, synthetic construct; identical to SEQ ID NO: 2296
  misc_feature 1..575: note = Synthetic polypeptide
  source 1..575: mol_type = other DNA

SEQ ID NO: 4090 - DNA, 487 bp, synthetic construct; identical to SEQ ID NO: 918
  misc_feature 1..487: note = Synthetic polypeptide
  source 1..487: mol_type = other DNA

SEQ ID NO: 4091 - DNA, 281 bp, synthetic construct; identical to SEQ ID NO: 2021
  misc_feature 1..281: note = Synthetic polypeptide
  source 1..281: mol_type = other DNA

SEQ ID NO: 4092 - DNA, 248 bp, synthetic construct; identical to SEQ ID NO: 2022
  misc_feature 1..248: note = Synthetic polypeptide
  source 1..248: mol_type = other DNA

SEQ ID NO: 4093 - DNA, 609 bp, synthetic construct; identical to SEQ ID NO: 249
  misc_feature 1..609: note = Synthetic polypeptide
  source 1..609: mol_type = other DNA

SEQ ID NO: 4094 - DNA, 738 bp, synthetic construct; identical to SEQ ID NO: 250
  misc_feature 1..738: note = Synthetic polypeptide
  source 1..738: mol_type = other DNA

SEQ ID NO: 4095 - DNA, 537 bp, synthetic construct; identical to SEQ ID NO: 251
  misc_feature 1..537: note = Synthetic polypeptide
  source 1..537: mol_type = other DNA

SEQ ID NO: 4096 - DNA, 684 bp, synthetic construct; identical to SEQ ID NO: 253
  misc_feature 1..684: note = Synthetic polypeptide
  source 1..684: mol_type = other DNA

SEQ ID NO: 4097 - DNA, 285 bp, synthetic construct; identical to SEQ ID NO: 255
  misc_feature 1..285: note = Synthetic polypeptide
  source 1..285: mol_type = other DNA

SEQ ID NO: 4098 - DNA, 552 bp, synthetic construct; identical to SEQ ID NO: 254
  misc_feature 1..552: note = Synthetic polypeptide
  source 1..552: mol_type = other DNA

SEQ ID NO: 4099 - DNA, 3203 bp, synthetic construct
  misc_feature 1..3203: note = Synthetic polypeptide
  source 1..3203: mol_type = other DNA
atgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgagttatctacatctgcagctcccctgatgccttcagaaccctcatgctcctggccctggaagctggcttgtgtggggaggactacgttttcttccacctggatatctttgggcaaagcctgcaaggtggacagggccctgctccccgcaggccctgggagagaggggatgggcaggatgtcagtgcccgccaggcctttcaggctgccaaaatcattacatataaagacccagataatcccgagtacttggaattcctgaagcagttaaaacacctggcctatgagcagttcaacttcaccatggaggatggcctggtgaacaccatcccagcatccttccacgacgggctcctgctctatatccaggcagtgacggagactctggcacatgggggaactgttactgatggggagaacatcactcagcggatgtggaaccgaagctttcaaggtgtgacaggatacctgaaaattgatagcagtggcgatcgggaaacagacttctccctctgggatatggatcccgagaatggtgccttcagggttgtactgaactacaatgggacttcccaagagctggtggctgtgtcggggcgcaaactgaactggcccctggggtaccctcctcctgacatccccaaatgtggctttgacaacgaagacccagcatgcaaccaagatcacctttccaccctggaggtgctggctttggtgggcagcctctccttgctcggcattctgattgtctccttcttcatatacaggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagggcaacctcgtggctgtgaaacgtgtgaaccgtaaacgcattgagctgacacgaaaagtcctgtttgaactgaagcatatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccaggtgtgatggcaggctcctgtaatcccagctacttgggaggctgaggcagaagaattgcttgaacccgggaggcagaggttgcgatgagccaagattacaccacgcaccccagcttgggcaataagagttaaactctgtctcaaaaaaaaaaaaaaaaaaaaaaaaaaa

SEQ ID NO: 4100 - DNA, 1412 bp, synthetic construct
  misc_feature 1..1412: note = Synthetic polypeptide
  source 1..1412: mol_type = other DNA
atggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggttgttgtcatctgagttgagcactggtcacattgaaggtgctgggtaagtggtagctct

SEQ ID NO: 4101 - DNA, 324 bp, synthetic construct
  misc_feature 1..324: note = Synthetic polypeptide
  source 1..324: mol_type = other DNA
ctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggttgttgtcatctgagttgagcactggtcacattgaaggtgctgggtaagtggtagctct

SEQ ID NO: 4102 - DNA, 764 bp, synthetic construct
  misc_feature 1..764: note = Synthetic polypeptide
  source 1..764: mol_type = other DNA
atgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggttgttgtcatctgagttgagcactggtcacattgaaggtgctgggtaagtggtagctct

SEQ ID NO: 4103 - DNA, 1289 bp, synthetic construct
  misc_feature 1..1289: note = Synthetic polypeptide
  source 1..1289: mol_type = other DNA
atgggggcgggggaacagaacaggcaaagtgcccactgtgtgcagggcatatgcgggtacctggagggagatgaagaaggggaagagggggaggtgcgaagcactcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggttgttgtcatctgagttgagcactggtcacattgaaggtgctgggtaagtggtagctct

SEQ ID NO: 4104 - DNA, 285 bp, synthetic construct
  misc_feature 1..285: note = Synthetic polypeptide
  source 1..285: mol_type = other DNA
aatccccatggtatctttggagaacctacctctgtagagaggcagtagactctgaagtcacctgtcgtaagaacgtgagctttcctcttcacatgctgcttatattccctattaagtttgtttcttttctagaaaaaattgaaagaactgtccagattgaggcttcaactgttgaaattgaagagcgaggggtcaagctacgcctgacagtggtagatacccctggctatggtgacgctatcaactgcagagattgtcacgttcctgaaaagaattggcagccct

SEQ ID NO: 4105 - DNA, 370 bp, synthetic construct
  misc_feature 1..370: note = Synthetic polypeptide
  source 1..370: mol_type = other DNA
atgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgtcacgttcctgaaaagaattggcagccct

SEQ ID NO: 4106 - DNA, 250 bp, synthetic construct
  misc_feature 1..250: note = Synthetic polypeptide
  source 1..250: mol_type = other DNA
atggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgtcacgttcctgaaaagaattggcagccct

SEQ ID NO: 4107 - DNA, 400 bp, synthetic construct
  misc_feature 1..400: note = Synthetic polypeptide
  source 1..400: mol_type = other DNA
atgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagctttgaacacaaggaaaacacttttatgggaaaaaattgaaagaactgtccagattgaggcttcaactgttgaaattgaagagcgaggggtcaagctacgcctgacagtggtagatacccctggctatggtgacgctatcaactgcagagattgtcacgttcctgaaaagaattggcagccct

SEQ ID NO: 4108 - DNA, 403 bp, synthetic construct
  misc_feature 1..403: note = Synthetic polypeptide
  source 1..403: mol_type = other DNA
atggagttcaactctaacgtcaagtcttggtccttttcattgcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgtcacgttcctgaaaagaattggcagccct

SEQ ID NO: 4109 - DNA, 317 bp, synthetic construct; identical to SEQ ID NO: 995
  misc_feature 1..317: note = Synthetic polypeptide
  source 1..317: mol_type = other DNA

SEQ ID NO: 4110 - DNA, 578 bp, synthetic construct; identical to SEQ ID NO: 1946
  misc_feature 1..578: note = Synthetic polypeptide
  source 1..578: mol_type = other DNA

SEQ ID NO: 4111 - DNA, 488 bp, synthetic construct; identical to SEQ ID NO: 1947
  misc_feature 1..488: note = Synthetic polypeptide
  source 1..488: mol_type = other DNA

SEQ ID NO: 4112 - DNA, 479 bp, synthetic construct; identical to SEQ ID NO: 1948
  misc_feature 1..479: note = Synthetic polypeptide
  source 1..479: mol_type = other DNA

SEQ ID NO: 4113 - DNA, 470 bp, synthetic construct; identical to SEQ ID NO: 1949
  misc_feature 1..470: note = Synthetic polypeptide
  source 1..470: mol_type = other DNA

SEQ ID NO: 4114 - DNA, 39 bp, synthetic construct; identical to SEQ ID NO: 2401
  misc_feature 1..39: note = Synthetic polypeptide
  source 1..39: mol_type = other DNA

SEQ ID NO: 4115 - DNA, 605 bp, synthetic construct
  misc_feature 1..605: note = Synthetic polypeptide
  source 1..605: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccaggggg

SEQ ID NO: 4116 - DNA, 542 bp, synthetic construct
  misc_feature 1..542: note = Synthetic polypeptide
  source 1..542: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttgtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccaggggg

SEQ ID NO: 4117 - DNA, 1834 bp, synthetic construct; identical to SEQ ID NO: 133
  misc_feature 1..1834: note = Synthetic polypeptide
  source 1..1834: mol_type = other DNA

SEQ ID NO: 4118 - DNA, 1765 bp, synthetic construct; identical to SEQ ID NO: 135
  misc_feature 1..1765: note = Synthetic polypeptide
  source 1..1765: mol_type = other DNA

SEQ ID NO: 4119 - DNA, 227 bp, synthetic construct
  misc_feature 1..227: note = Synthetic polypeptide
  source 1..227: mol_type = other DNA
atggagctgcctgctgtgaacctgaaggtgattctcctaggtcactggctgctgacaacctggtcactttgggccagacagctctgcctctccgggtcttgatttccgtctgtacaataggcataaggattgcacaccctgcaggagctgggagggagacgtggaagtgctcatcagagctccccagggcctgccccacagtgaggcctcagcactgcagcttgatt

SEQ ID NO: 4120 - DNA, 263 bp, synthetic construct
  misc_feature 1..263: note = Synthetic polypeptide
  source 1..263: mol_type = other DNA
atggagctgcctgctgtgaacctgaagtgcgccagctccagtgtcccaagaaatcaccctcacgtgattctcctaggtcactggctgctgacaacctggtcactttgggccagacagctctgcctctccgggtcttgatttccgtctgtacaataggcataaggattgcacaccctgcaggagctgggagggagacgtggaagtgctcatcagagctccccagggcctgccccacagtgaggcctcagcactgcagcttgatt

SEQ ID NO: 4121 - DNA, 303 bp, synthetic construct; identical to SEQ ID NO: 148
  misc_feature 1..303: note = Synthetic polypeptide
  source 1..303: mol_type = other DNA

SEQ ID NO: 4122 - DNA, 301 bp, synthetic construct; identical to SEQ ID NO: 147
  misc_feature 1..301: note = Synthetic polypeptide
  source 1..301: mol_type = other DNA

SEQ ID NO: 4123 - DNA, 5801 bp, synthetic construct; identical to SEQ ID NO: 2012
  misc_feature 1..5801: note = Synthetic polypeptide
  source 1..5801: mol_type = other DNA

SEQ ID NO: 4124 - DNA, 708 bp, synthetic construct; identical to SEQ ID NO: 2013
  misc_feature 1..708: note = Synthetic polypeptide
  source 1..708: mol_type = other DNA

SEQ ID NO: 4125 - DNA, 169 bp, synthetic construct
  misc_feature 1..169: note = Synthetic polypeptide
  source 1..169: mol_type = other DNA
atggcaaccgttccaggtgtggtggtgcaggcctgtaatcccagctactcagaaggctgaggcaggagaatcgcttgaacctgggaggcagaagttgcagtgagccaagatcgcgccactgcattccagcctgggcgacaaagcgagactctgtctccaaaaaaaaaaa

SEQ ID NO: 4126 - DNA, 610 bp, synthetic construct; identical to SEQ ID NO: 163
  misc_feature 1..610: note = Synthetic polypeptide
  source 1..610: mol_type = other DNA

SEQ ID NO: 4127 - DNA, 216 bp, synthetic construct
  misc_feature 1..216: note = Synthetic polypeptide
  source 1..216: mol_type = other DNA
atggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccctagcaaaccaa

SEQ ID NO: 4128 - DNA, 150 bp, synthetic construct
  misc_feature 1..150: note = Synthetic polypeptide
  source 1..150: mol_type = other DNA
gtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccctagcaaaccaa

SEQ ID NO: 4129 - DNA, 79 bp, synthetic construct
  misc_feature 1..79: note = Synthetic polypeptide
  source 1..79: mol_type = other DNA
cagtctagccggcctgggtgcttaccagctgtatcaggatccaaggaacgtttggggtttcctagccctagcaaaccaa

SEQ ID NO: 4130 - DNA, 438 bp, synthetic construct
  misc_feature 1..438: note = Synthetic polypeptide
  source 1..438: mol_type = other DNA
atggggcctgaaaggcatctgtcaggcgcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagcccctgaaccaagatcctgaacaagaggaggtggaactggcaccagtgggggatggagatgtagttgctgacatccaggatcgaatccaggccctggggcttcatttgccagacccaccattagagagtgaagatgaagatgaggagggagctacagcgttgaacaaccacagctctattcccatggacccaggaatgtataatgtacaaaatagaagactgcct

SEQ ID NO: 4131 - DNA, 1441 bp, synthetic construct
  misc_feature 1..1441: note = Synthetic polypeptide
  source 1..1441: mol_type = other DNA
atggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgtaacactcaccacgaaggtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 4132 - DNA, 1450 bp, synthetic construct
  misc_feature 1..1450: note = Synthetic polypeptide
  source 1..1450: mol_type = other DNA
atggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaggtgaaagagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgtaacactcaccacgaaggtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 4133 - DNA, 887 bp, synthetic construct
  misc_feature 1..887: note = Synthetic polypeptide
  source 1..887: mol_type = other DNA
gggaagcccagtggaggacaatgagaaggatctggtgaaactggctaaacgcctcaagaaggagaaagtaaatgttgacattatcaattttggggaagaggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgtaacactcaccacgaaggtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 4134 - DNA, 561 bp, synthetic construct
  misc_feature 1..561: note = Synthetic polypeptide
  source 1..561: mol_type = other DNA
acattgatgccagctcagctatggacacatctgagccagccaagagctcaattaacagagttctcagcaggcccctctatttggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgtaacactcaccacgaaggtctgcagcttcactcctgaagccagcgagaccacgaacccaccgggaggaacgaacaactccagatgcgccgccttaagagctgtaacactcaccgcgaaggtccgtggcctcactcctgagcccccaagaccacgaacccaccagaaggaagaaactccaaacacatccgaacatcagaaggaacaaactctggacacgctgactttaagaactgtaacactcaccgcgaaggtctgcggcttcattcttgaagtcagtgagaccaagaacccaccaattccggacaca

SEQ ID NO: 4135 - DNA, 503 bp, synthetic construct
  misc_feature 1..503: note = Synthetic polypeptide
  source 1..503: mol_type = other DNA
atgtgtggaactggggggactgattccaagacaaggcgcccaccccacagagcaagttttctgaaacgtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgaggggagggga

SEQ ID NO: 4136 - DNA, 413 bp, synthetic construct
  misc_feature 1..413: note = Synthetic polypeptide
  source 1..413: mol_type = other DNA
atggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgaggggagggga

SEQ ID NO: 4137 - DNA, 415 bp, synthetic construct; identical to SEQ ID NO: 2355
  misc_feature 1..415: note = Synthetic polypeptide
  source 1..415: mol_type = other DNA

SEQ ID NO: 4138 - DNA, 259 bp, synthetic construct; identical to SEQ ID NO: 2356
  misc_feature 1..259: note = Synthetic polypeptide
  source 1..259: mol_type = other DNA

SEQ ID NO: 4139 - DNA, 559 bp, synthetic construct; identical to SEQ ID NO: 1701
  misc_feature 1..559: note = Synthetic polypeptide
  source 1..559: mol_type = other DNA

SEQ ID NO: 4140 - DNA, 2153 bp, synthetic construct; identical to SEQ ID NO: 217
  misc_feature 1..2153: note = Synthetic polypeptide
  source 1..2153: mol_type = other DNA

SEQ ID NO: 4141 - DNA, 1664 bp, synthetic construct; identical to SEQ ID NO: 222
  misc_feature 1..1664: note = Synthetic polypeptide
  source 1..1664: mol_type = other DNA

SEQ ID NO: 4142 - DNA, 1766 bp, synthetic construct; identical to SEQ ID NO: 221
  misc_feature 1..1766: note = Synthetic polypeptide
  source 1..1766: mol_type = other DNA

SEQ ID NO: 4143 - DNA, 281 bp, synthetic construct; identical to SEQ ID NO: 1368
  misc_feature 1..281: note = Synthetic polypeptide
  source 1..281: mol_type = other DNA

SEQ ID NO: 4144 - DNA, 674 bp, synthetic construct
  misc_feature 1..674: note = Synthetic polypeptide
  source 1..674: mol_type = other DNA
atggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaa

SEQ ID NO: 4145 - DNA, 620 bp, synthetic construct
  misc_feature 1..620: note = Synthetic polypeptide
  source 1..620: mol_type = other DNA
atgcctgccctccggacaaggcggggttggtggccagggcgaccgcggggcgggccagcgccgggggtcgtggccgggacacgtggtacggaaccggcgccgcgcttgctgctggtaacagggccttgcctagtgggccttccttcccagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaa

SEQ ID NO: 4146 - DNA, 586 bp, synthetic construct; identical to SEQ ID NO: 401
  misc_feature 1..586: note = Synthetic polypeptide
  source 1..586: mol_type = other DNA

SEQ ID NO: 4147 - DNA, 829 bp, synthetic construct; identical to SEQ ID NO: 402
  misc_feature 1..829: note = Synthetic polypeptide
  source 1..829: mol_type = other DNA

SEQ ID NO: 4148 - DNA, 1060 bp, synthetic construct; identical to SEQ ID NO: 403
  misc_feature 1..1060: note = Synthetic polypeptide
  source 1..1060: mol_type = other DNA

SEQ ID NO: 4149 - DNA, 730 bp, synthetic construct; identical to SEQ ID NO: 406
  misc_feature 1..730: note = Synthetic polypeptide
  source 1..730: mol_type = other DNA

SEQ ID NO: 4150 - DNA, 496 bp, synthetic construct; identical to SEQ ID NO: 408
  misc_feature 1..496: note = Synthetic polypeptide
  source 1..496: mol_type = other DNA

SEQ ID NO: 4151 - DNA, 3881 bp, synthetic construct; identical to SEQ ID NO: 1162
  misc_feature 1..3881: note = Synthetic polypeptide
  source 1..3881: mol_type = other DNA

SEQ ID NO: 4152 - DNA, 3722 bp, synthetic construct; identical to SEQ ID NO: 1163
  misc_feature 1..3722: note = Synthetic polypeptide
  source 1..3722: mol_type = other DNA

SEQ ID NO: 4153 - DNA, 535 bp, synthetic construct; identical to SEQ ID NO: 2819
  misc_feature 1..535: note = Synthetic polypeptide
  source 1..535: mol_type = other DNA

SEQ ID NO: 4154 - DNA, 1041 bp, synthetic construct; identical to SEQ ID NO: 2160
  misc_feature 1..1041: note = Synthetic polypeptide
  source 1..1041: mol_type = other DNA

SEQ ID NO: 4155 - DNA, 987 bp, synthetic construct; identical to SEQ ID NO: 2161
  misc_feature 1..987: note = Synthetic polypeptide
  source 1..987: mol_type = other DNA

SEQ ID NO: 4156 - DNA, 1089 bp, synthetic construct; identical to SEQ ID NO: 2162
  misc_feature 1..1089: note = Synthetic polypeptide
  source 1..1089: mol_type = other DNA

SEQ ID NO: 4157 - DNA, 678 bp, synthetic construct; identical to SEQ ID NO: 2163
  misc_feature 1..678: note = Synthetic polypeptide
  source 1..678: mol_type = other DNA

SEQ ID NO: 4158 - DNA, 1868 bp, synthetic construct
  misc_feature 1..1868: note = Synthetic polypeptide
  source 1..1868: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggagggaaggagagggagggtgggtgggtgggaggggg

SEQ ID NO: 4159 - DNA, 535 bp, synthetic construct; identical to SEQ ID NO: 2819
  misc_feature 1..535: note = Synthetic polypeptide
  source 1..535: mol_type = other DNA

SEQ ID NO: 4160 - DNA, 441 bp, synthetic construct
  misc_feature 1..441: note = Synthetic polypeptide
  source 1..441: mol_type = other DNA
atgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4161 - DNA, 419 bp, synthetic construct
  misc_feature 1..419: note = Synthetic polypeptide
  source 1..419: mol_type = other DNA
tgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4162 - DNA, 272 bp, synthetic construct
  misc_feature 1..272: note = Synthetic polypeptide
  source 1..272: mol_type = other DNA
ggagcctgcgcctgtgggattcccacgtatgcggagtgagcctgctcagccaccgctgggcactcacggcggcgcactgctttgaaacataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4163 - DNA, 1806 bp, synthetic construct
  misc_feature 1..1806: note = Synthetic polypeptide
  source 1..1806: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccccgcatcctagtcccacccacccccatcctcagttcctccccc

SEQ ID NO: 4164 - DNA, 1854 bp, synthetic construct
  misc_feature 1..1854: note = Synthetic polypeptide
  source 1..1854: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggagggtgggtgggtgggaggggg

SEQ ID NO: 4165 - DNA, 258 bp, synthetic construct; identical to SEQ ID NO: 265
  misc_feature 1..258: note = Synthetic polypeptide
  source 1..258: mol_type = other DNA

SEQ ID NO: 4166 - DNA, 243 bp, synthetic construct; identical to SEQ ID NO: 267
  misc_feature 1..243: note = Synthetic polypeptide
  source 1..243: mol_type = other DNA

SEQ ID NO: 4167 - DNA, 324 bp, synthetic construct; identical to SEQ ID NO: 268
  misc_feature 1..324: note = Synthetic polypeptide
  source 1..324: mol_type = other DNA

SEQ ID NO: 4168 - DNA, 2161 bp, synthetic construct; identical to SEQ ID NO: 288
  misc_feature 1..2161: note = Synthetic polypeptide
  source 1..2161: mol_type = other DNA

SEQ ID NO: 4169 - DNA, 2140 bp, synthetic construct; identical to SEQ ID NO: 289
  misc_feature 1..2140: note = Synthetic polypeptide
  source 1..2140: mol_type = other DNA

SEQ ID NO: 4170 - DNA, 529 bp, synthetic construct; identical to SEQ ID NO: 287
  misc_feature 1..529: note = Synthetic polypeptide
  source 1..529: mol_type = other DNA

SEQ ID NO: 4171 - DNA, 1075 bp, synthetic construct
  misc_feature 1..1075: note = Synthetic polypeptide
  source 1..1075: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgggg

SEQ ID NO: 4172 - DNA, 951 bp, synthetic construct; identical to SEQ ID NO: 1109
  misc_feature 1..951: note = Synthetic polypeptide
  source 1..951: mol_type = other DNA

SEQ ID NO: 4173 - DNA, 1036 bp, synthetic construct; identical to SEQ ID NO: 1110
  misc_feature 1..1036: note = Synthetic polypeptide
  source 1..1036: mol_type = other DNA

SEQ ID NO: 4174 - DNA, 871 bp, synthetic construct; identical to SEQ ID NO: 1111
  misc_feature 1..871: note = Synthetic polypeptide
  source 1..871: mol_type = other DNA

SEQ ID NO: 4175 - DNA, 569 bp, synthetic construct; identical to SEQ ID NO: 1768
  misc_feature 1..569: note = Synthetic polypeptide
  source 1..569: mol_type = other DNA

SEQ ID NO: 4176 - DNA, 497 bp, synthetic construct; identical to SEQ ID NO: 1769
  misc_feature 1..497: note = Synthetic polypeptide
  source 1..497: mol_type = other DNA

SEQ ID NO: 4177 - DNA, 415 bp, synthetic construct
  misc_feature 1..415: note = Synthetic polypeptide
  source 1..415: mol_type = other DNA
atgtgtggaactggggggactgattccaagacaaggcgcccaccccacagagcaagttttctgaaacgtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggagggga

SEQ ID NO: 4178 - DNA, 325 bp, synthetic construct
  misc_feature 1..325: note = Synthetic polypeptide
  source 1..325: mol_type = other DNA
atggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggagggga

SEQ ID NO: 4179 - DNA, 951 bp, synthetic construct; identical to SEQ ID NO: 1127
  misc_feature 1..951: note = Synthetic polypeptide
  source 1..951: mol_type = other DNA

SEQ ID NO: 4180 - DNA, 1036 bp, synthetic construct; identical to SEQ ID NO: 1128
  misc_feature 1..1036: note = Synthetic polypeptide
  source 1..1036: mol_type = other DNA

SEQ ID NO: 4181 - DNA, 871 bp, synthetic construct; identical to SEQ ID NO: 1129
  misc_feature 1..871: note = Synthetic polypeptide
  source 1..871: mol_type = other DNA

SEQ ID NO: 4182 - DNA, 839 bp, synthetic construct
  misc_feature 1..839: note = Synthetic polypeptide
  source 1..839: mol_type = other DNA
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaat

SEQ ID NO: 4183 - DNA, 924 bp, synthetic construct
  misc_feature 1..924: note = Synthetic polypeptide
  source 1..924: mol_type = other DNA
atggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaat

SEQ ID NO: 4184 - DNA, 759 bp, synthetic construct
  misc_feature 1..759: note = Synthetic polypeptide
  source 1..759: mol_type = other DNA
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaat

SEQ ID NO: 4185 - DNA, 775 bp, synthetic construct; identical to SEQ ID NO: 215
  misc_feature 1..775: note = Synthetic polypeptide
  source 1..775: mol_type = other DNA

SEQ ID NO: 4186 - DNA, 839 bp, synthetic construct
  misc_feature 1..839: note = Synthetic polypeptide
  source 1..839: mol_type = other DNA
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaat

SEQ ID NO: 4187 - DNA, 924 bp, synthetic construct
  misc_feature 1..924: note = Synthetic polypeptide
  source 1..924: mol_type = other DNA
atggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaat

SEQ ID NO: 4188 - DNA, 759 bp, synthetic construct
  misc_feature 1..759: note = Synthetic polypeptide
  source 1..759: mol_type = other DNA
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaat

SEQ ID NO: 4189 - DNA, 47 bp, synthetic construct; identical to SEQ ID NO: 2014
  misc_feature 1..47: note = Synthetic polypeptide
  source 1..47: mol_type = other DNA

SEQ ID NO: 4190 - DNA, 577 bp, synthetic construct; identical to SEQ ID NO: 1112
  misc_feature 1..577: note = Synthetic polypeptide
  source 1..577: mol_type = other DNA

SEQ ID NO: 4191 - DNA, 252 bp, synthetic construct; identical to SEQ ID NO: 1113
  misc_feature 1..252: note = Synthetic polypeptide
  source 1..252: mol_type = other DNA

SEQ ID NO: 4192 - DNA, 310 bp, synthetic construct
  misc_feature 1..310: note = Synthetic polypeptide
  source 1..310: mol_type = other DNA
atggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagcagccctagcaaaccaa

SEQ ID NO: 4193 - DNA, 208 bp, synthetic construct
  misc_feature 1..208: note = Synthetic polypeptide
  source 1..208: mol_type = other DNA
atggagaagcccctcttcccattagtgcctttgcattggtttggctttggctacacagcactggttgtttctggtgggatcgttggctatgtaaaaacagccgctacatctgttacttttgttggtgttatgggaatgagatcctactactatggaaaattcatgcctgtaggtttaattgcaggtgccagcagccctagcaaaccaa

SEQ ID NO: 4194 - DNA, 131 bp, synthetic construct
  misc_feature 1..131: note = Synthetic polypeptide
  source 1..131: mol_type = other DNA
atggagaagcccctcttcccattccgctacatctgttacttttgttggtgttatgggaatgagatcctactactatggaaaattcatgcctgtaggtttaattgcaggtgccagcagccctagcaaaccaa

SEQ ID NO: 4195 - DNA, 173 bp, synthetic construct
  misc_feature 1..173: note = Synthetic polypeptide
  source 1..173: mol_type = other DNA
cagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagcagccctagcaaaccaa

SEQ ID NO: 4196 - DNA, 2962 bp, synthetic construct; identical to SEQ ID NO: 2377
  misc_feature 1..2962: note = Synthetic polypeptide
  source 1..2962: mol_type = other DNA

SEQ ID NO: 4197 - DNA, 2899 bp, synthetic construct; identical to SEQ ID NO: 2378
  misc_feature 1..2899: note = Synthetic polypeptide
  source 1..2899: mol_type = other DNA

SEQ ID NO: 4198 - DNA, 2902 bp, synthetic construct; identical to SEQ ID NO: 2379
  misc_feature 1..2902: note = Synthetic polypeptide
  source 1..2902: mol_type = other DNA

SEQ ID NO: 4199 - DNA, 2839 bp, synthetic construct; identical to SEQ ID NO: 2380
  misc_feature 1..2839: note = Synthetic polypeptide
  source 1..2839: mol_type = other DNA

SEQ ID NO: 4200 - DNA, 1195 bp, synthetic construct
  misc_feature 1..1195: note = Synthetic polypeptide
  source 1..1195: mol_type = other DNA
atggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggtacttggagggctcagggcagtggcttctttccagtatggaaggatttcaacattttaatagttggttaggctaaactggtgcatactggcattggccct

SEQ ID NO: 4201 - DNA, 1183 bp, synthetic construct
  misc_feature 1..1183: note = Synthetic polypeptide
  source 1..1183: mol_type = other DNA
atggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggtacttggagggctcagggcagtggcttctttccagtatggaaggatttcaacattttaatagttggttaggctaaactggtgcatactggcattggccct

SEQ ID NO: 4202 - DNA, 163 bp, synthetic construct
  misc_feature 1..163: note = Synthetic polypeptide
  source 1..163: mol_type = other DNA
atggcccgggccgctgccctcctgccgtcgagatcgccgccgacgccgctgctgtggccgctgctgctgctgctgctcctggaaaccggactattcacaataccaaagacatggactcaatccaaatgcccatcatggatagactggataaagaaaatgtaca

SEQ ID NO: 4203 - DNA, 568 bp, synthetic construct; identical to SEQ ID NO: 1967
  misc_feature 1..568: note = Synthetic polypeptide
  source 1..568: mol_type = other DNA

SEQ ID NO: 4204 - DNA, 379 bp, synthetic construct; identical to SEQ ID NO: 1968
  misc_feature 1..379: note = Synthetic polypeptide
  source 1..379: mol_type = other DNA

SEQ ID NO: 4205 - DNA, 1024 bp, synthetic construct
  misc_feature 1..1024: note = Synthetic polypeptide
  source 1..1024: mol_type = other DNA
atggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 4206 - DNA, 970 bp, synthetic construct
  misc_feature 1..970: note = Synthetic polypeptide
  source 1..970: mol_type = other DNA
atggagggagctgctttgctgagagtctctgtcctctgcatctgggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 4207 - DNA, 1072 bp, synthetic construct
  misc_feature 1..1072: note = Synthetic polypeptide
  source 1..1072: mol_type = other DNA
atgagattcaaaagccacactgtggaattgaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 4208 - DNA, 661 bp, synthetic construct
  misc_feature 1..661: note = Synthetic polypeptide
  source 1..661: mol_type = other DNA
atgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 4209 - DNA, 2160 bp, synthetic construct
  misc_feature 1..2160: note = Synthetic polypeptide
  source 1..2160: mol_type = other DNA
atgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcctacatcaacgggtcgagggcttcgccggccaacctgtccccgcagccggaggtctacgggcatttcctgggcgtgcgcggcagctgcattccccagccgcgcccggtgcccggcagccagaagggcgtgctggtggcccctggaggcctggcgctgccggcctacggcgaggacggggccctggagcacgagcgcatgcaacagctggagcacggcggcctgcagccaggcctggtcaaccacatggtggtgcagcatggcctgccgggccccgacagccagtcggccggcctgttcaagaccgaacgcctggaggagttcccgggcagcaccgtagacctaccccccgcgcctccgctccctcctctgccgccgcccccaggccccccacccccttaccatgcccatgcgcaccttcaccacccggagctcgggccccacgcccagcagctggccttgccccaggccaccctggacgacgacggggagatggacggcatcgggggcaagcattgctgccgctggatcgactgcagcgccctgtacgaccagcaggaggagctcgtgcggcacatcgagaaggtccacatcgaccagcgcaaaggggaggacttcacttgcttctgggccggttgccctcgaagatacaagcccttcaacgcccgctataaactgctgatccacatgagagtccactctggggagaagcccaacaagtgtacgtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccaaaccttatgcttgtcaaattccaggatgtaccaaacgctacacagacccaagttccctaagaaagcatgtgaaggcacattcttccaaagagcaacaagcaaggaaaaagttgcggtccagcacagagctccatccagacctgctcacagattgcctcaccgtgcagtccctgcagccggccacttcccctagagatgctgctgctgaagggaccgtgggacgctcccctggacccgggcctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggtccacatcctctccgtccttcaaggcgcaggtggaatgacacctcctctctgaagcccttcctgatcccccagctgatgtcatctctccaggctctaaactctgattttatatcgcctgtctttctctggtagtatttatgcttcctctac

SEQ ID NO: 4210 - DNA, 2625 bp, synthetic construct
  misc_feature 1..2625: note = Synthetic polypeptide
  source 1..2625: mol_type = other DNA
atgaatggaagatcatgcagcatgagtctccaccggacatcgggaaccccacaggggcctaggatggtcagtggtcatcacattcctgccatccgagcccactccgggactcctggcccctcgccctgtggcagcacatcgagtcccactatggcaagccttgctaacaacctccatctcaagatgccctcaggaggagggatggctcctcagaacaacgtggctgagagccgcatccatctgcctgccttaagccccaggagacaaatgctcaccaatgggaagccgcgattccaggtcacccaggctggaggcatgtcagggtcacatactttaaagccaaagcagcaggagtttggaagcccttttcctccaaatcctgggaaaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcctacatcaacgggtcgagggcttcgccggccaacctgtccccgcagccggaggtctacgggcatttcctgggcgtgcgcggcagctgcattccccagccgcgcccggtgcccggcagccagaagggcgtgctggtggcccctggaggcctggcgctgccggcctacggcgaggacggggccctggagcacgagcgcatgcaacagctggagcacggcggcctgcagccaggcctggtcaaccacatggtggtgcagcatggcctgccgggccccgacagccagtcggccggcctgttcaagaccgaacgcctggaggagttcccgggcagcaccgtagacctaccccccgcgcctccgctccctcctctgccgccgcccccaggccccccacccccttaccatgcccatgcgcaccttcaccacccggagctcgggccccacgcccagcagctggccttgccccaggccaccctggacgacgacggggagatggacggcatcgggggcaagcattgctgccgctggatcgactgcagcgccctgtacgaccagcaggaggagctcgtgcggcacatcgagaaggtccacatcgaccagcgcaaaggggaggacttcacttgcttctgggccggttgccctcgaagatacaagcccttcaacgcccgctataaactgctgatccacatgagagtccactctggggagaagcccaacaagtgtacgtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacaccaaaccttatgcttgtcaaattccaggatgtaccaaacgctacacagacccaagttccctaagaaagcatgtgaaggcacattcttccaaagagcaacaagcaaggaaaaagttgcggtccagcacagagctccatccagacctgctcacagattgcctcaccgtgcagtccctgcagccggccacttcccctagagatgctgctgctgaagggaccgtgggacgctcccctggacccgggcctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggtccacatcctctccgtccttcaaggcgcaggtggaatgacacctcctctctgaagcccttcctgatcccccagctgatgtcatctctccaggctctaaactctgattttatatcgcctgtctttctctggtagtatttatgcttcctctac

SEQ ID NO: 4211 - DNA, 436 bp, synthetic construct; identical to SEQ ID NO: 2387
  misc_feature 1..436: note = Synthetic polypeptide
  source 1..436: mol_type = other DNA

SEQ ID NO: 4212 - DNA, 454 bp, synthetic construct; identical to SEQ ID NO: 2388
  misc_feature 1..454: note = Synthetic polypeptide
  source 1..454: mol_type = other DNA

SEQ ID NO: 4213 - DNA, 349 bp, synthetic construct; identical to SEQ ID NO: 2389
  misc_feature 1..349: note = Synthetic polypeptide
  source 1..349: mol_type = other DNA

SEQ ID NO: 4214 - DNA, 577 bp, synthetic construct; identical to SEQ ID NO: 2390
  misc_feature 1..577: note = Synthetic polypeptide
  source 1..577: mol_type = other DNA

SEQ ID NO: 4215 - DNA, 439 bp, synthetic construct; identical to SEQ ID NO: 2391
  misc_feature 1..439: note = Synthetic polypeptide
  source 1..439: mol_type = other DNA

SEQ ID NO: 4216 - DNA, 616 bp, synthetic construct; identical to SEQ ID NO: 2392
  misc_feature 1..616: note = Synthetic polypeptide
  source 1..616: mol_type = other DNA

SEQ ID NO: 4217 - DNA, 459 bp, synthetic construct; identical to SEQ ID NO: 237
  misc_feature 1..459: note = Synthetic polypeptide
  source 1..459: mol_type = other DNA

SEQ ID NO: 4218 - DNA, 158 bp, synthetic construct
  misc_feature 1..158: note = Synthetic polypeptide
  source 1..158: mol_type = other DNA
atgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcag

SEQ ID NO: 4219 - DNA, 65 bp, synthetic construct
  misc_feature 1..65: note = Synthetic polypeptide
  source 1..65: mol_type = other DNA
atggccacagaagttgctgctgacgctctgggtgaagaatggaagggttatgtggtccgaatcag

SEQ ID NO: 4220 - DNA, 335 bp, synthetic construct; identical to SEQ ID NO: 2120
  misc_feature 1..335: note = Synthetic polypeptide
  source 1..335: mol_type = other DNA

SEQ ID NO: 4221 - DNA, 615 bp, synthetic construct; identical to SEQ ID NO: 1055
  misc_feature 1..615: note = Synthetic polypeptide
  source 1..615: mol_type = other DNA

SEQ ID NO: 4222 - DNA, 861 bp, synthetic construct; identical to SEQ ID NO: 1056
  misc_feature 1..861: note = Synthetic polypeptide
  source 1..861: mol_type = other DNA

SEQ ID NO: 4223 - DNA, 62 bp, synthetic construct; identical to SEQ ID NO: 1057
  misc_feature 1..62: note = Synthetic polypeptide
  source 1..62: mol_type = other DNA

SEQ ID NO: 4224 - DNA, 123 bp, synthetic construct; identical to SEQ ID NO: 1058
  misc_feature 1..123: note = Synthetic polypeptide
  source 1..123: mol_type = other DNA

SEQ ID NO: 4225 - DNA, 585 bp, synthetic construct; identical to SEQ ID NO: 2385
  misc_feature 1..585: note = Synthetic polypeptide
  source 1..585: mol_type = other DNA

SEQ ID NO: 4226 - DNA, 579 bp, synthetic construct; identical to SEQ ID NO: 2386
  misc_feature 1..579: note = Synthetic polypeptide
  source 1..579: mol_type = other DNA

SEQ ID NO: 4227 - DNA, 1487 bp, synthetic construct; identical to SEQ ID NO: 2023
  misc_feature 1..1487: note = Synthetic polypeptide
  source 1..1487: mol_type = other DNA

SEQ ID NO: 4228 - DNA, 1538 bp, synthetic construct; identical to SEQ ID NO: 2024
  misc_feature 1..1538: note = Synthetic polypeptide
  source 1..1538: mol_type = other DNA

SEQ ID NO: 4229 - DNA, 1427 bp, synthetic construct; identical to SEQ ID NO: 2025
  misc_feature 1..1427: note = Synthetic polypeptide
  source 1..1427: mol_type = other DNA

SEQ ID NO: 4230 - DNA, 237 bp, synthetic construct
  misc_feature 1..237: note = Synthetic polypeptide
  source 1..237: mol_type = other DNA
atgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggctaaggtgtttcattgtaacctgaatggaccaag

SEQ ID NO: 4231 - DNA, 660 bp, synthetic construct
  misc_feature 1..660: note = Synthetic polypeptide
  source 1..660: mol_type = other DNA
atgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggctaaggtgtttcattgtaacctgaatggaccaag

SEQ ID NO: 4232 - DNA, 506 bp, synthetic construct; identical to SEQ ID NO: 1096
  misc_feature 1..506: note = Synthetic polypeptide
  source 1..506: mol_type = other DNA

SEQ ID NO: 4233 - DNA, 435 bp, synthetic construct
  misc_feature 1..435: note = Synthetic polypeptide
  source 1..435: mol_type = other DNA
atgtgtggaactggggggactgattccaagacaaggcgcccaccccacagagcaagttttctgaaacgtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggagggaagaggaggagaggggagggga

SEQ ID NO: 4234 - DNA, 345 bp, synthetic construct
  misc_feature 1..345: note = Synthetic polypeptide
  source 1..345: mol_type = other DNA
atggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggagggaagaggaggagaggggagggga

SEQ ID NO: 4235 - DNA, 1859 bp, synthetic construct
  misc_feature 1..1859: note = Synthetic polypeptide
  source 1..1859: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggggg

SEQ ID NO: 4236 - DNA, 728 bp, synthetic construct
  misc_feature 1..728: note = Synthetic polypeptide
  source 1..728: mol_type = other DNA
atgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4237 - DNA, 734 bp, synthetic construct
  misc_feature 1..734: note = Synthetic polypeptide
  source 1..734: mol_type = other DNA
atgggcgcgcgcggggcgctgctgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4238 - DNA, 706 bp, synthetic construct
  misc_feature 1..706: note = Synthetic polypeptide
  source 1..706: mol_type = other DNA
tgctggcgctgctgctggctcgggctggactcaggaagccggagtcgcaggaggcggcgccgttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4239 - DNA, 559 bp, synthetic construct
  misc_feature 1..559: note = Synthetic polypeptide
  source 1..559: mol_type = other DNA
ggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagac

SEQ ID NO: 4240 - DNA, 557 bp, synthetic construct
  misc_feature 1..557: note = Synthetic polypeptide
  source 1..557: mol_type = other DNA
atggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggaggatcgcttgagaccaagagtttgagcctgcggtgagctgtgaatgcaccacggcactcaagcctgggcaatgtagcaagatcctgtctctacaagaaa

SEQ ID NO: 4241 - DNA, 503 bp, synthetic construct
  misc_feature 1..503: note = Synthetic polypeptide
  source 1..503: mol_type = other DNA
atgcctgccctccggacaaggcggggttggtggccagggcgaccgcggggcgggccagcgccgggggtcgtggccgggacacgtggtacggaaccggcgccgcgcttgctgctggtaacagggccttgcctagtgggccttccttcccagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggaggatcgcttgagaccaagagtttgagcctgcggtgagctgtgaatgcaccacggcactcaagcctgggcaatgtagcaagatcctgtctctacaagaaa

SEQ ID NO: 4242 - DNA, 3093 bp, synthetic construct; identical to SEQ ID NO: 341
  misc_feature 1..3093: note = Synthetic polypeptide
  source 1..3093: mol_type = other DNA

SEQ ID NO: 4243 - DNA, 2979 bp, synthetic construct; identical to SEQ ID NO: 342
  misc_feature 1..2979: note = Synthetic polypeptide
  source 1..2979: mol_type = other DNA

SEQ ID NO: 4244 - DNA, 3078 bp, synthetic construct; identical to SEQ ID NO: 343
  misc_feature 1..3078: note = Synthetic polypeptide
  source 1..3078: mol_type = other DNA

SEQ ID NO: 4245 - DNA, 3072 bp, synthetic construct; identical to SEQ ID NO: 346
  misc_feature 1..3072: note = Synthetic polypeptide
  source 1..3072: mol_type = other DNA

SEQ ID NO: 4246 - DNA, 1935 bp, synthetic construct; identical to SEQ ID NO: 347
  misc_feature 1..1935: note = Synthetic polypeptide
  source 1..1935: mol_type = other DNA

SEQ ID NO: 4247 - DNA, 1096 bp, synthetic construct; identical to SEQ ID NO: 348
  misc_feature 1..1096: note = Synthetic polypeptide
  source 1..1096: mol_type = other DNA

SEQ ID NO: 4248 - DNA, 902 bp, synthetic construct; identical to SEQ ID NO: 349
  misc_feature 1..902: note = Synthetic polypeptide
  source 1..902: mol_type = other DNA

SEQ ID NO: 4249 - DNA, 874 bp, synthetic construct; identical to SEQ ID NO: 350
  misc_feature 1..874: note = Synthetic polypeptide
  source 1..874: mol_type = other DNA

SEQ ID NO: 4250 - DNA, 1296 bp, synthetic construct; identical to SEQ ID NO: 1428
  misc_feature 1..1296: note = Synthetic polypeptide
  source 1..1296: mol_type = other DNA

SEQ ID NO: 4251 - DNA, 1299 bp, synthetic construct; identical to SEQ ID NO: 1429
  misc_feature 1..1299: note = Synthetic polypeptide
  source 1..1299: mol_type = other DNA

SEQ ID NO: 4252 - DNA, 543 bp, synthetic construct; identical to SEQ ID NO: 1430
  misc_feature 1..543: note = Synthetic polypeptide
  source 1..543: mol_type = other DNA

SEQ ID NO: 4253 - DNA, 1194 bp, synthetic construct; identical to SEQ ID NO: 1431
  misc_feature 1..1194: note = Synthetic polypeptide
  source 1..1194: mol_type = other DNA

SEQ ID NO: 4254 - DNA, 706 bp, synthetic construct; identical to SEQ ID NO: 1432
  misc_feature 1..706: note = Synthetic polypeptide
  source 1..706: mol_type = other DNA

SEQ ID NO: 4255 - DNA, 578 bp, synthetic construct; identical to SEQ ID NO: 1433
  misc_feature 1..578: note = Synthetic polypeptide
  source 1..578: mol_type = other DNA

SEQ ID NO: 4256 - DNA, 564 bp, synthetic construct; identical to SEQ ID NO: 1434
  misc_feature 1..564: note = Synthetic polypeptide
  source 1..564: mol_type = other DNA

SEQ ID NO: 4257 - DNA, 513 bp, synthetic construct; identical to SEQ ID NO: 1435
  misc_feature 1..513: note = Synthetic polypeptide
  source 1..513: mol_type = other DNA

SEQ ID NO: 4258 - DNA, 299 bp, synthetic construct; identical to SEQ ID NO: 1033
  misc_feature 1..299: note = Synthetic polypeptide
  source 1..299: mol_type = other DNA

SEQ ID NO: 4259 - DNA, 191 bp, synthetic construct; identical to SEQ ID NO: 1034
  misc_feature 1..191: note = Synthetic polypeptide
  source 1..191: mol_type = other DNA

SEQ ID NO: 4260 - DNA, 516 bp, synthetic construct
  misc_feature 1..516: note = Synthetic polypeptide
  source 1..516: mol_type = other DNA
atggaactcttaacattcagggatgtggccatagaattctctccagaagagtggaaatgcctggaccctgcccagcagaatttgtatagagatgtgatgttggagaactacaggaacctgatctccctgggtgttgctatctctaacccagacctggtcatctatctggagcaaagaaaggagccctacaaagtgaagatacatgagacagtagccaaacacccaggccactggactatgctccaccttcagtctgagccagcatacaaccctcttgatacctctcccaagaacaggctgacttcagggtgaaacattctctaatcttgaatctgattttgctgttctccattctgccctctgccatcttctttctaatcttgtttgctcctccatatgaaaaatagcctttatctgtctcattttggaggtgcttgcagatcttatgcttggtgctttttccattgcaatactccttaaaataaagtcacttcttacctacatcagaatttattt

SEQ ID NO: 4261 - DNA, 241 bp, synthetic construct
  misc_feature 1..241: note = Synthetic polypeptide
  source 1..241: mol_type = other DNA
atgcctctcctgcgtgggcgctgtcctgcccgccgccactaccgccgcttggccctgctcggcctgcagcccgctccccgcttcgcccactcggggcccccgcgccagcggcccctgtctgccgcggtatggtggtgtgcacctggaattccagctacttgggagactgaagcagaaggatcacttgaggccaggagtttgagaccagcctggacaacatagtgagattcctgtctcaaaa

SEQ ID NO: 4262 - DNA, 2095 bp, synthetic construct; identical to SEQ ID NO: 2095
  misc_feature 1..2095: note = Synthetic polypeptide
  source 1..2095: mol_type = other DNA

SEQ ID NO: 4263 - DNA, 55 bp, synthetic construct; identical to SEQ ID NO: 291
  misc_feature 1..55: note = Synthetic polypeptide
  source 1..55: mol_type = other DNA

SEQ ID NO: 4264 - DNA, 25 bp, synthetic construct
  misc_feature 1..25: note = Synthetic polypeptide
  source 1..25: mol_type = other DNA
atgagcgtcctttcgtttttttaaa

SEQ ID NO: 4265 - DNA, 918 bp, synthetic construct
  misc_feature 1..918: note = Synthetic polypeptide
  source 1..918: mol_type = other DNA
atggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggaggctgaggcaggagaatcgcttgaacccgggaggcagaggttgcggtgagccgagatcgtgccgttgcactccagcctgggaacaacagcgaaaccctgtctcaaaaaaaaaattaaaaaaataaaataa

SEQ ID NO: 4266 - DNA, 684 bp, synthetic construct
  misc_feature 1..684: note = Synthetic polypeptide
  source 1..684: mol_type = other DNA
atgatgggagcctcaacacttcaggagccggccctaagtcctggcaggtgcccccgccagcccctgaggtccaaattcggacaccaagggtcaactgtccagagaaagtgctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggaggctgaggcaggagaatcgcttgaacccgggaggcagaggttgcggtgagccgagatcgtgccgttgcactccagcctgggaacaacagcgaaaccctgtctcaaaaaaaaaattaaaaaaataaaataa

SEQ ID NO: 4267 - DNA, 918 bp, synthetic construct
  misc_feature 1..918: note = Synthetic polypeptide
  source 1..918: mol_type = other DNA
atggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaacatcagtggggcctcacctgcccgccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggaggctgaggcaggagaatcgcttgaacccgggaggcagaggttgcggtgagccgagatcgtgccgttgcactccagcctgggaacaacagcgaaaccctgtctcaaaaaaaaaattaaaaaaataaaataa

SEQ ID NO: 4268 - DNA, 693 bp, synthetic construct
  misc_feature 1..693: note = Synthetic polypeptide
  source 1..693: mol_type = other DNA
atggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggaggctgaggcaggagaatcgcttgaacccgggaggcagaggttgcggtgagccgagatcgtgccgttgcactccagcctgggaacaacagcgaaaccctgtctcaaaaaaaaaattaaaaaaataaaataa

SEQ ID NO: 4269 - DNA, 228 bp, synthetic construct
  misc_feature 1..228: note = Synthetic polypeptide
  source 1..228: mol_type = other DNA
cccctgcagaaaatgttccagtgcccatatttcttctttgacgttgtttacatccacaatggcactgaggagaaggaggaggagatgagttggaaggaggctgaggcaggagaatcgcttgaacccgggaggcagaggttgcggtgagccgagatcgtgccgttgcactccagcctgggaacaacagcgaaaccctgtctcaaaaaaaaaattaaaaaaataaaataa

SEQ ID NO: 4270 - DNA, 1863 bp, synthetic construct
  misc_feature 1..1863: note = Synthetic polypeptide
  source 1..1863: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggagagggagggtgggtgggtgggaggggg

SEQ ID NO: 4271 - DNA, 118 bp, synthetic construct
  misc_feature 1..118: note = Synthetic polypeptide
  source 1..118: mol_type = other DNA
atgccgcgcccccgcctgctggccgcgctgtgcggcgcgctgctctgcgcccccagcctcctcgtcgccctggacccagctcaaatattccctcctctggggaacttctaattcccca

SEQ ID NO: 4272 - DNA, 865 bp, synthetic construct; identical to SEQ ID NO: 366
  misc_feature 1..865: note = Synthetic polypeptide
  source 1..865: mol_type = other DNA

SEQ ID NO: 4273 - DNA, 391 bp, synthetic construct
  misc_feature 1..391: note = Synthetic polypeptide
  source 1..391: mol_type = other DNA
atgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccagattacttcctccacccctccctatctca

SEQ ID NO: 4274 - DNA, 399 bp, synthetic construct
  misc_feature 1..399: note = Synthetic polypeptide
  source 1..399: mol_type = other DNA
atgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcggcgcgggacgcaggccgggcgcgggagggcgcgg

SEQ ID NO: 4275 - DNA, 429 bp, synthetic construct
  misc_feature 1..429: note = Synthetic polypeptide
  source 1..429: mol_type = other DNA
cccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtatgtgtgctccgatgcttggggggctgtgggggctgccggagtcggggtatgccctcacccacccctcctgtctctgtgcaggtgctatgctcgccttcaccctcgtgctgtcaactgccgcaagaagaagtgtggtcacaccaacaacctgcggcgcgggacgcaggccgggcgcgggagggcgcgg

SEQ ID NO: 4276 - DNA, 278 bp, synthetic construct
  misc_feature 1..278: note = Synthetic polypeptide
  source 1..278: mol_type = other DNA
gtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaaaagtgtggtcacaccaacaacctgcggcgcgggacgcaggccgggcgcgggagggcgcgg

SEQ ID NO: 4277 - DNA, 1980 bp, synthetic construct
  misc_feature 1..1980: note = Synthetic polypeptide
  source 1..1980: mol_type = other DNA
atgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgagatcctgaacttcacagatgagctcacaccacccagattgataaactggcctatctcatcctgtggccccctcccaggaagtgactcagcacgagaggacagtatcaactccctatgatttcatctctcacctgaccaatcagaactcttgactcactggcccccctacccaccaaattatctttaaaaactccagtcctcaaattctcagagagactgatttgaataataacaaaactctggtgtactgcacagctggctctgcatgaattactctttattgcaatttctctgttttgataagtaagatctttcttgataaataagctctgtctaggcagtgggcaaggtgaacccgttaggtggttaca

SEQ ID NO: 4278 - DNA, 1584 bp, synthetic construct
  misc_feature 1..1584: note = Synthetic polypeptide
  source 1..1584: mol_type = other DNA
atggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgagatcctgaacttcacagatgagctcacaccacccagattgataaactggcctatctcatcctgtggccccctcccaggaagtgactcagcacgagaggacagtatcaactccctatgatttcatctctcacctgaccaatcagaactcttgactcactggcccccctacccaccaaattatctttaaaaactccagtcctcaaattctcagagagactgatttgaataataacaaaactctggtgtactgcacagctggctctgcatgaattactctttattgcaatttctctgttttgataagtaagatctttcttgataaataagctctgtctaggcagtgggcaaggtgaacccgttaggtggttaca

SEQ ID NO: 4279 - DNA, 1974 bp, synthetic construct
  misc_feature 1..1974: note = Synthetic polypeptide
  source 1..1974: mol_type = other DNA
atgtttctgaccaagaattgcaagcaagaacaggaaagagtggagtcggccaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgagatcctgaacttcacagatgagctcacaccacccagattgataaactggcctatctcatcctgtggccccctcccaggaagtgactcagcacgagaggacagtatcaactccctatgatttcatctctcacctgaccaatcagaactcttgactcactggcccccctacccaccaaattatctttaaaaactccagtcctcaaattctcagagagactgatttgaataataacaaaactctggtgtactgcacagctggctctgcatgaattactctttattgcaatttctctgttttgataagtaagatctttcttgataaataagctctgtctaggcagtgggcaaggtgaacccgttaggtggttaca

SEQ ID NO: 4280 - DNA, 177 bp, synthetic construct
  misc_feature 1..177: note = Synthetic polypeptide
  source 1..177: mol_type = other DNA
atggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagagaaaaatatttgttgaatgagtgaa

SEQ ID NO: 4281 - DNA, 567 bp, synthetic construct
  misc_feature 1..567: note = Synthetic polypeptide
  source 1..567: mol_type = other DNA
atggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaattacctccatgttgcaggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaaaacccagtgctttggtgtttgga

SEQ ID NO: 4282 - DNA, 495 bp, synthetic construct
  misc_feature 1..495: note = Synthetic polypeptide
  source 1..495: mol_type = other DNA
atggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaattacctccatgttgcaggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaaaacccagtgctttggtgtttgga

SEQ ID NO: 4283 - DNA, 840 bp, synthetic construct; identical to SEQ ID NO: 1937
  misc_feature 1..840: note = Synthetic polypeptide
  source 1..840: mol_type = other DNA

SEQ ID NO: 4284 - DNA, 757 bp, synthetic construct
  misc_feature 1..757: note = Synthetic polypeptide
  source 1..757: mol_type = other DNA
atgctgaaaagcaacggggagagacgcagtcgtaacgcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaa

SEQ ID NO: 4285 - DNA, 624 bp, synthetic construct
  misc_feature 1..624: note = Synthetic polypeptide
  source 1..624: mol_type = other DNA
atggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgccaccaagcccgacgcagtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaa

SEQ ID NO: 4286 - DNA, 694 bp, synthetic construct
  misc_feature 1..694: note = Synthetic polypeptide
  source 1..694: mol_type = other DNA
atggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaa

SEQ ID NO: 4287 - DNA, 717 bp, synthetic construct
  misc_feature 1..717: note = Synthetic polypeptide
  source 1..717: mol_type = other DNA
atggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctggtaagaagccttctggacacgggcgcctggcgcatgagtgcctgtcacagagttgtgacagtgccaagcactctccaacgttggtgcccacagccaccaagcccgacgcagtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaa

SEQ ID NO: 4288 - DNA, 396 bp, synthetic construct
  misc_feature 1..396: note = Synthetic polypeptide
  source 1..396: mol_type = other DNA
atgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggctacaaaaatctgactcattcttcaagacctagttccagagccacctcctccaggaaaacttccaagtcctccaggc

SEQ ID NO: 4289 - DNA, 95 bp, synthetic construct
  misc_feature 1..95: note = Synthetic polypeptide
  source 1..95: mol_type = other DNA
atgtcgcgatccaaccggcagaaggagtacaaatgcggggacctggtgttcgccaagatgaagggctacccacactggccggcccggagttccct

SEQ ID NO: 4290 - DNA, 584 bp, synthetic construct
  misc_feature 1..584: note = Synthetic polypeptide
  source 1..584: mol_type = other DNA
atggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctgggttgttggtgtggagtggaagatgaggcggcaccttctaagcagagtatttatatacaaagagagactcagatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaggacggctctgcgtgaattactatttctccatcgcaattccccagtcttcataaatcggctctgtctaggcagctggcaacgtgaacccactggacggttaca

SEQ ID NO: 4291 - DNA, 167 bp, synthetic construct
  misc_feature 1..167: note = Synthetic polypeptide
  source 1..167: mol_type = other DNA
atggagttgcagaagggaaaaggggcggcagcagcagcagctgcttcgggagcagcgggaggtggaggaggaggagcgggagcaggagccccaggaggggggaggctgctactttcaaccagtttggatgccaaggatgagttagaggagatctctgcacacagaag

SEQ ID NO: 4292 - DNA, 508 bp, synthetic construct
  misc_feature 1..508: note = Synthetic polypeptide
  source 1..508: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggaggggg

SEQ ID NO: 4293 - DNA, 445 bp, synthetic construct
  misc_feature 1..445: note = Synthetic polypeptide
  source 1..445: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttgtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggaggggg

SEQ ID NO: 4294 - DNA, 729 bp, synthetic construct; identical to SEQ ID NO: 202
  misc_feature 1..729: note = Synthetic polypeptide
  source 1..729: mol_type = other DNA

SEQ ID NO: 4295 - DNA, 1142 bp, synthetic construct; identical to SEQ ID NO: 2159
  misc_feature 1..1142: note = Synthetic polypeptide
  source 1..1142: mol_type = other DNA

SEQ ID NO: 4296 - DNA, 1327 bp, synthetic construct
  misc_feature 1..1327: note = Synthetic polypeptide
  source 1..1327: mol_type = other DNA
atgtccatccacttcagctccccggtattcacctcgcgctcagccgccttctcgggccgcggcgcccaggtgcgcctgagctccgctcgccccggcggccttggcagcagcagcctctacggcctcggcgcctcacggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccaccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcgcagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcggggcaagcaggatatggcacggcagctgcgtgagtaccaggaactcatgagcgtgaagctggccctggacatcgagatcgccacctaccgcaagctgctggagggcgaggagagccggtaaaggaagcttttcaagatctatcaactgaggacaatcaaacccttcacaatctagaatgcagagatcaggtcatctggagacgatatctgagaaagactgccattgagccccattggag

SEQ ID NO: 4297 - DNA, 572 bp, synthetic construct; identical to SEQ ID NO: 159
  misc_feature 1..572: note = Synthetic polypeptide
  source 1..572: mol_type = other DNA

SEQ ID NO: 4298 - DNA, 792 bp, synthetic construct
  misc_feature 1..792: note = Synthetic polypeptide
  source 1..792: mol_type = other DNA
atgcagcccccgcccccgggcccgctgggcgactgcctgcgggactgggaggatctacagcaggacttccagaacatccaggagacccatcggctctaccgcctgaagctggaggagctgaccaaactttagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggcaaggtca

SEQ ID NO: 4299 - DNA, 77 bp, synthetic construct; identical to SEQ ID NO: 1778
  misc_feature 1..77: note = Synthetic polypeptide
  source 1..77: mol_type = other DNA

SEQ ID NO: 4300 - DNA, 1213 bp, synthetic construct; identical to SEQ ID NO: 1093
  misc_feature 1..1213: note = Synthetic polypeptide
  source 1..1213: mol_type = other DNA

SEQ ID NO: 4301 - DNA, 616 bp, synthetic construct; identical to SEQ ID NO: 1094
  misc_feature 1..616: note = Synthetic polypeptide
  source 1..616: mol_type = other DNA

SEQ ID NO: 4302 - DNA, 868 bp, synthetic construct; identical to SEQ ID NO: 1095
  misc_feature 1..868: note = Synthetic polypeptide
  source 1..868: mol_type = other DNA

SEQ ID NO: 4303 - DNA, 598 bp, synthetic construct
  misc_feature 1..598: note = Synthetic polypeptide
  source 1..598: mol_type = other DNA
atggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggccatgcaaggacacagtgagaaggtgaccatatgcaagccaggaagaagaccttcaccaggaatccaaccagctggcacgttgaccttggacttcttggactccagaactatgagaaataaatgtctgctgtttaagccacctaggtgacagcattctgtgacagcagcctgcactaagaca

SEQ ID NO: 4304 - DNA, 526 bp, synthetic construct
  misc_feature 1..526: note = Synthetic polypeptide
  source 1..526: mol_type = other DNA
atggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttccttcagcacctcacccactggacagagcccatacacctaccagatgcacggccatgcaaggacacagtgagaaggtgaccatatgcaagccaggaagaagaccttcaccaggaatccaaccagctggcacgttgaccttggacttcttggactccagaactatgagaaataaatgtctgctgtttaagccacctaggtgacagcattctgtgacagcagcctgcactaagaca

SEQ ID NO: 4305 - DNA, 457 bp, synthetic construct
  misc_feature 1..457: note = Synthetic polypeptide
  source 1..457: mol_type = other DNA
cagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggccatgcaaggacacagtgagaaggtgaccatatgcaagccaggaagaagaccttcaccaggaatccaaccagctggcacgttgaccttggacttcttggactccagaactatgagaaataaatgtctgctgtttaagccacctaggtgacagcattctgtgacagcagcctgcactaagaca

SEQ ID NO: 4306 - DNA, 798 bp, synthetic construct; identical to SEQ ID NO: 3839
  misc_feature 1..798: note = Synthetic polypeptide
  source 1..798: mol_type = other DNA

SEQ ID NO: 4307 - DNA, 349 bp, synthetic construct
  misc_feature 1..349: note = Synthetic polypeptide
  source 1..349: mol_type = other DNA
atggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggtgtttctcc

SEQ ID NO: 4308 - DNA, 340 bp, synthetic construct
  misc_feature 1..340: note = Synthetic polypeptide
  source 1..340: mol_type = other DNA
ccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggtgtttctcc

SEQ ID NO: 4309 - DNA, 707 bp, synthetic construct
  misc_feature 1..707: note = Synthetic polypeptide
  source 1..707: mol_type = other DNA
atggcccgttcttacggcggccgggtgctggctgcaatgaccctgctgggcatcgcggcggccgtgctggcggcgctgggcgcgcagctgctgtttcagctgcaggcgggccgcgccgagctgcgggggctgcgcgccgaggggctgggccaggagctgggcgccggccccgggctgccagaggacgcggccgggacgctgctgccgctggccgccgcgctggccgcgctggtgctcgtgctggggttcacctgcttgctgctcgccgcgctctgtggccacctgggcgccgagctggcgcgggggcctggccccaggaggtctgactggtttctctacgactgccgcctcctcagacatgtggcccttggccttttctgctgtgggatctccgtctatttagcaggccggacgcggtggctcacgcctgtaatcccagcactttgggagaccgaggcgggcagatcacgaggtcaggagatcgagaccatcctggctaacaaggtgaaaccccatctctactaaaaatacaaaaattagccgggtgtggtggcgggcggctgtagtcccagctactcgggaggctgaggcaggagaatggcgtgaacccgggaggcagagcttgcagtgagccgagattgcgccactgcactccagcctgggtgacagagcgagattccatctcaaaaaaaaaaaaaaaaaaaaaa

SEQ ID NO: 4310 - DNA, 662 bp, synthetic construct
  misc_feature 1..662: note = Synthetic polypeptide
  source 1..662: mol_type = other DNA
atgccaaagaaatggcttttcctgccctttgaggatgatctgaggagggacctcgggcgccagttctcagtggagcgcctgccggcggtcgtggtgctcaagccggacggggacgtgctcactcgcgacggcgccgacgagatccagcgcctgggcaccgcctgcttcgccaactggcaggaggcggccgaggtgctggaccgcaacttccagctgccagaggacctggaggaccaggagccacggagcctcaccgagtgcctgcgccgccacaagtctgactggtttctctacgactgccgcctcctcagacatgtggcccttggccttttctgctgtgggatctccgtctatttagcaggccggacgcggtggctcacgcctgtaatcccagcactttgggagaccgaggcgggcagatcacgaggtcaggagatcgagaccatcctggctaacaaggtgaaaccccatctctactaaaaatacaaaaattagccgggtgtggtggcgggcggctgtagtcccagctactcgggaggctgaggcaggagaatggcgtgaacccgggaggcagagcttgcagtgagccgagattgcgccactgcactccagcctgggtgacagagcgagattccatctcaaaaaaaaaaaaaaaaaaaaaa

SEQ ID NO: 4311 - DNA, 798 bp, synthetic construct
  misc_feature 1..798: note = Synthetic polypeptide
  source 1..798: mol_type = other DNA
atggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggaaatgattgatgaagctgatcgagatggagatggagagggacatggatggagctggaagccattatcctcagcaaactaacccaggaacaggaaaccaaacaccacttgttctcactcgtgagtgggagctgaacagagagaacacgtagttacagggaaggggacaatatacataggggcctgtcggtggcagtgggggtgggggtgtggggggagggagaacatcaggataaatagctaatgcatgtggggcttaacacctaggtgatgggttgataggtgcagcaaaccaccgtggcacacgtttacctatgcaaccagcacgtcctgcacatgtatcccggaacttaacttaaaaaaaaaaaaa

SEQ ID NO: 4312 - DNA, 614 bp, synthetic construct
  misc_feature 1..614: note = Synthetic polypeptide
  source 1..614: mol_type = other DNA
atgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtagaggttggagtgagccaagatcatgctactgcactctccagcctgggctacagagtgagactctcaaaaaaaaaaaataataataataagagaaa

SEQ ID NO: 4313 - DNA, 704 bp, synthetic construct
  misc_feature 1..704: note = Synthetic polypeptide
  source 1..704: mol_type = other DNA
atgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgatgaggacgcaagcaagcgcactcttcagatgtcacttctcacgggaggcctctgtgattgcagaaggaaaggccccagcagaactcaccatctgccgcctgaggctccaccacctcgaagacatccttgcaagatccacagactggcccagaccaggaggtttctgtcttcttcttgtgtcttcttcactctcctggactggttcgtgaaccctttctcctatctctgtttcctctggatgttaagtgctactttctttgttgtggaacgttaacctgtaacatgtatatactgattaagtacactattacgttgtcgtgtgcaatattggctgacatgtgcagtggcttgagcccgtgtgaccgcagctctcactactgagggaaaggagcactaagcagcatgcctccttgggaacgccgtgtggctcgtggctttagggattgaaatagcctcaataaaattctgacattgtgaaagacacaggcatgcttggatgtgattatctctaactttgcactgctcatgaca

SEQ ID NO: 4314 - DNA, 364 bp, synthetic construct; identical to SEQ ID NO: 2649
  misc_feature 1..364: note = Synthetic polypeptide
  source 1..364: mol_type = other DNA

SEQ ID NO: 4315 - DNA, 1312 bp, synthetic construct
  misc_feature 1..1312: note = Synthetic polypeptide
  source 1..1312: mol_type = other DNA
atggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcccacgtctggccaggcactgccttctcctctctgggcctttgtttccttgttggtcagaggagtgattgaaccagctcatctccaaggatcctctccactccatgtttgcaatgcttttat

SEQ ID NO: 4316 - DNA, 1069 bp, synthetic construct
  misc_feature 1..1069: note = Synthetic polypeptide
  source 1..1069: mol_type = other DNA
atggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccgcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcccacgtctggccaggcactgccttctcctctctgggcctttgtttccttgttggtcagaggagtgattgaaccagctcatctccaaggatcctctccactccatgtttgcaatgcttttat

SEQ ID NO: 4317 - DNA, 1132 bp, synthetic construct
  misc_feature 1..1132: note = Synthetic polypeptide
  source 1..1132: mol_type = other DNA
atggccgagggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcccacgtctggccaggcactgccttctcctctctgggcctttgtttccttgttggtcagaggagtgattgaaccagctcatctccaaggatcctctccactccatgtttgcaatgcttttat

SEQ ID NO: 4318 - DNA, 1394 bp, synthetic construct; identical to SEQ ID NO: 1118
  misc_feature 1..1394: note = Synthetic polypeptide
  source 1..1394: mol_type = other DNA

SEQ ID NO: 4319 - DNA, 1625 bp, synthetic construct; identical to SEQ ID NO: 1119
  misc_feature 1..1625: note = Synthetic polypeptide
  source 1..1625: mol_type = other DNA

SEQ ID NO: 4320 - DNA, 1505 bp, synthetic construct; identical to SEQ ID NO: 1120
  misc_feature 1..1505: note = Synthetic polypeptide
  source 1..1505: mol_type = other DNA

SEQ ID NO: 4321 - DNA, 1562 bp, synthetic construct; identical to SEQ ID NO: 1121
  misc_feature 1..1562: note = Synthetic polypeptide
  source 1..1562: mol_type = other DNA

SEQ ID NO: 4322 - DNA, 1601 bp, synthetic construct; identical to SEQ ID NO: 1122
  misc_feature 1..1601: note = Synthetic polypeptide
  source 1..1601: mol_type = other DNA

SEQ ID NO: 4323 - DNA, 1631 bp, synthetic construct; identical to SEQ ID NO: 1123
  misc_feature 1..1631: note = Synthetic polypeptide
  source 1..1631: mol_type = other DNA

SEQ ID NO: 4324 - DNA, 976 bp, synthetic construct; identical to SEQ ID NO: 2334
  misc_feature 1..976: note = Synthetic polypeptide
  source 1..976: mol_type = other DNA

SEQ ID NO: 4325 - DNA, 1009 bp, synthetic construct; identical to SEQ ID NO: 2335
  misc_feature 1..1009: note = Synthetic polypeptide
  source 1..1009: mol_type = other DNA

SEQ ID NO: 4326 - DNA, 1132 bp, synthetic construct; identical to SEQ ID NO: 2336
  misc_feature 1..1132: note = Synthetic polypeptide
  source 1..1132: mol_type = other DNA

SEQ ID NO: 4327 - DNA, 563 bp, synthetic construct; identical to SEQ ID NO: 2337
  misc_feature 1..563: note = Synthetic polypeptide
  source 1..563: mol_type = other DNA

SEQ ID NO: 4328 - DNA, 396 bp, synthetic construct
  misc_feature 1..396: note = Synthetic polypeptide
  source 1..396: mol_type = other DNA
atggaagatgcactctttctgcggatcagtgtttgagatattttgcagaccctgcacttgatggatcagctggcaccaccgactaataaactggcttatctgatgttgtggcctccactcaggaactgactgaaggcaggaagacagcttcaactccctgtgatttcacccctgaccaatcaccacacctggctcactggctaccccccaactcccacccaccaagttatccttaaaaactctgctctccaaatgctcagggagactgatttgagtaataaaactccagtctcccacacagctggctctgcgtgaattactttattgcaactcccctgccttgatgaattggctctgtctaggcagcaggcaaggtgaaccccttgggtggttaca

SEQ ID NO: 4329 - DNA, 1979 bp, synthetic construct
  misc_feature 1..1979: note = Synthetic polypeptide
  source 1..1979: mol_type = other DNA
atggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgattcactctctaccagctctttgacctagaaaggttgcttttaaggacaacatcagcaaaccactttccttccagctattatttggttcagcaagtggagggc

SEQ ID NO: 4330 - DNA, 1931 bp, synthetic construct
  misc_feature 1..1931: note = Synthetic polypeptide
  source 1..1931: mol_type = other DNA
atggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgattcactctctaccagctctttgacctagaaaggttgcttttaaggacaacatcagcaaaccactttccttccagctattatttggttcagcaagtggagggc

SEQ ID NO: 4331 - DNA, 52 bp, synthetic construct
  misc_feature 1..52: note = Synthetic polypeptide
  source 1..52: mol_type = other DNA
atgacgcgctgggtgcccaccaagcgcgaggagaagtacggcgtggcacctg

SEQ ID NO: 4332 - DNA, 997 bp, synthetic construct
  misc_feature 1..997: note = Synthetic polypeptide
  source 1..997: mol_type = other DNA
atggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggctataagcaccataagggcagagaccatgaacatttttttttatttccccaaccacgcgcagtacacagggcagaattgctcaataaatatttgttgaatgaatgaat

SEQ ID NO: 4333 - DNA, 610 bp, synthetic construct
  misc_feature 1..610: note = Synthetic polypeptide
  source 1..610: mol_type = other DNA
cagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggctataagcaccataagggcagagaccatgaacatttttttttatttccccaaccacgcgcagtacacagggcagaattgctcaataaatatttgttgaatgaatgaat

SEQ ID NO: 4334 - DNA, 1875 bp, synthetic construct
  misc_feature 1..1875: note = Synthetic polypeptide
  source 1..1875: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccagggggtgggtgggtgggaggggg

SEQ ID NO: 4335 - DNA, 1622 bp, synthetic construct
  misc_feature 1..1622: note = Synthetic polypeptide
  source 1..1622: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccggggg

SEQ ID NO: 4336 - DNA, 1119 bp, synthetic construct
  misc_feature 1..1119: note = Synthetic polypeptide
  source 1..1119: mol_type = other DNA
atgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtgggtagatcacctgaggtcaggagttcgaggtcaacctgagcaacaaggtaaaatcccatctttactaataatacaaaaattagccaggcgtggtggtgtgcacctgtagtcccagctactcgggaggctgaggcaggggaatcgcttgaacctgggaggcggaggttgcagtgagctgagatcgcaccactgcactccagcctgggtgacagagcgagactctgtctcaaaataaataaataaataaataaa

SEQ ID NO: 4337 - DNA, 316 bp, synthetic construct; identical to SEQ ID NO: 2265
  misc_feature 1..316: note = Synthetic polypeptide
  source 1..316: mol_type = other DNA

SEQ ID NO: 4338 - DNA, 383 bp, synthetic construct
  misc_feature 1..383: note = Synthetic polypeptide
  source 1..383: mol_type = other DNA
atggcagcggctgcgccgaggcgcccgactcagatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaggacggctctgcgtgaattactatttctccatcgcaattccccagtcttcataaatcggctctgtctaggcagctggcaacgtgaacccactggacggttaca

SEQ ID NO: 4339 - DNA, 415 bp, synthetic construct
  misc_feature 1..415: note = Synthetic polypeptide
  source 1..415: mol_type = other DNA
atggaactccacatcctggagcaccggctgcaagttgccagcgtcgccaaggagagtatcccgctgttcacctacggcctgatcaaacttgccttcctgtcctccaagaccagatcccttgctctgtaggaaaccaacccccaaggcctgaagacacccaagcagccccatggagaggcccatatggagaggaactgaggcatcccacccccaaccggcagctcggggctttgaaaacagatccttccgccccaggcaagccttccaatggattgcagccccagccaatgccttgaactgccaagttcagccacacctaaattcctaacccataggaactgtgagagataataaaagtttgttgttgtttcaagccactaagatctggggtaatttgttatgtagcaacagataa

SEQ ID NO: 4340 - DNA, 831 bp, synthetic construct
  misc_feature 1..831: note = Synthetic polypeptide
  source 1..831: mol_type = other DNA
caggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctgggggtggggacctcactggatgcacaatgttatgtctgtgctttcctgagcagaggatccctaaatttcattatattttaaaagacatctgtgacc

SEQ ID NO: 4341 - DNA, 848 bp, synthetic construct
  misc_feature 1..848: note = Synthetic polypeptide
  source 1..848: mol_type = other DNA
atgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctgggggtggggacctcactggatgcacaatgttatgtctgtgctttcctgagcagaggatccctaaatttcattatattttaaaagacatctgtgacc

SEQ ID NO: 4342 - DNA, 198 bp, synthetic construct
  misc_feature 1..198: note = Synthetic polypeptide
  source 1..198: mol_type = other DNA
atgtcgtccgacttcgaaggttacgagcaggacttcgcggtgctcactgcagagatcaccagcaagattgcgagggtcccacgactcccgcctgcacatcttattttctatgctagactgtcaactatgtgaaggtgggagctgtgtctgatttccttggcgtttacttattaggggctcaggaaaataagtgaatga

SEQ ID NO: 4343 - DNA, 1866 bp, synthetic construct
  misc_feature 1..1866: note = Synthetic polypeptide
  source 1..1866: mol_type = other DNA
atgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggatactggggtccttttcccactcttccactgacttgctgtgtgaccttaggaagtctctgcccctctctcagcctcagtgtcc

SEQ ID NO: 4344 - DNA, 1986 bp, synthetic construct
  misc_feature 1..1986: note = Synthetic polypeptide
  source 1..1986: mol_type = other DNA
atgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagtacagtggccattcgctggcccctcacaggcctggctggggagatgcacggagaatggagaatgtccccaggcctgggagctcagggtgtccgtcctcctcgctcagggcccgggacctgggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggatactggggtccttttcccactcttccactgacttgctgtgtgaccttaggaagtctctgcccctctctcagcctcagtgtcc

SEQ ID NO: 4345 - DNA, 216 bp, synthetic construct
  misc_feature 1..216: note = Synthetic polypeptide
  source 1..216: mol_type = other DNA
atgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtggaggaggaggaagaggagaaggaaaagtgacgaagagagaggaggaggggg

SEQ ID NO: 4346 - DNA, 249 bp, synthetic construct
  misc_feature 1..249: note = Synthetic polypeptide
  source 1..249: mol_type = other DNA
atggtagcaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtggaggaggaggaagaggagaaggaaaagtgacgaagagagaggaggaggggg

SEQ ID NO: 4347 - DNA, 92 bp, synthetic construct; identical to SEQ ID NO: 1765
  misc_feature 1..92: note = Synthetic polypeptide
  source 1..92: mol_type = other DNA

SEQ ID NO: 4348 - DNA, 531 bp, synthetic construct; identical to SEQ ID NO: 2507
  misc_feature 1..531: note = Synthetic polypeptide
  source 1..531: mol_type = other DNA

SEQ ID NO: 4349 - DNA, 294 bp, synthetic construct; identical to SEQ ID NO: 2508
  misc_feature 1..294: note = Synthetic polypeptide
  source 1..294: mol_type = other DNA

SEQ ID NO: 4350 - DNA, 316 bp, synthetic construct; identical to SEQ ID NO: 2509
  misc_feature 1..316: note = Synthetic polypeptide
  source 1..316: mol_type = other DNA

SEQ ID NO: 4351 - DNA, 1648 bp, synthetic construct
  misc_feature 1..1648: note = Synthetic polypeptide
  source 1..1648: mol_type = other DNA
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagggg

SEQ ID NO: 4352 - DNA, 425 bp, synthetic construct
  misc_feature 1..425: note = Synthetic polypeptide
  source 1..425: mol_type = other DNA
atgtgtggaactggggggactgattccaagacaaggcgcccaccccacagagcaagttttctgaaacgtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggagaggggagggga

SEQ ID NO: 4353 - DNA, 335 bp, synthetic construct
  misc_feature 1..335: note = Synthetic polypeptide
  source 1..335: mol_type = other DNA
atggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggagaggggagggga

SEQ ID NO: 4354 - DNA, 916 bp, synthetic construct; identical to SEQ ID NO: 1226
  misc_feature 1..916: note = Synthetic polypeptide
  source 1..916: mol_type = other DNA

SEQ ID NO: 4355 - DNA, 268 bp, synthetic construct
  misc_feature 1..268: note = Synthetic polypeptide
  source 1..268: mol_type = other DNA
atgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggattgcttgaggccaggagttcaagaccagcctgggcaacacagcaagatcctgtctttgtaaaaaa

SEQ ID NO: 4356 - DNA, 226 bp, synthetic construct
  misc_feature 1..226: note = Synthetic polypeptide
  source 1..226: mol_type = other DNA
atgtacctgcaggtggagacccgcaccagctcccgcctccatctgaagagggctccaggcatccggtcctggtccctgctggttgatagcctgggctggaagctcttctacgtcacaggctgcctgtttgtggctgtgcagaacttggaggactgggaggattgcttgaggccaggagttcaagaccagcctgggcaacacagcaagatcctgtctttgtaaaaaa

SEQ ID NO: 4357 - DNA, 264 bp, synthetic construct
  misc_feature 1..264: note = Synthetic polypeptide
  source 1..264: mol_type = other DNA
atgtacctgcaggtggagacccgcaccagctcccgcctccatctgaagagggctccaggcatccggtcctggtccctgctggaatcttgtcgattggcctggctgctgcctactacagcggagatagcctgggctggaagctcttctacgtcacaggctgcctgtttgtggctgtgcagaacttggaggactgggaggattgcttgaggccaggagttcaagaccagcctgggcaacacagcaagatcctgtctttgtaaaaaa

SEQ ID NO: 4358 - DNA, 3308 bp, synthetic construct; identical to SEQ ID NO: 428
  misc_feature 1..3308: note = Synthetic polypeptide
  source 1..3308: mol_type = other DNA

SEQ ID NO: 4359 - DNA, 3203 bp, synthetic construct; identical to SEQ ID NO: 429
  misc_feature 1..3203: note = Synthetic polypeptide
  source 1..3203: mol_type = other DNA

SEQ ID NO: 4360 - DNA, 2849 bp, synthetic construct; identical to SEQ ID NO: 430
  misc_feature 1..2849: note = Synthetic polypeptide
  source 1..2849: mol_type = other DNA

SEQ ID NO: 4361 - DNA, 388 bp, synthetic construct; identical to SEQ ID NO: 431
  misc_feature 1..388: note = Synthetic polypeptide
  source 1..388: mol_type = other DNA

SEQ ID NO: 4362 - DNA, 1064 bp, synthetic construct
  misc_feature 1..1064: note = Synthetic polypeptide
  source 1..1064: mol_type = other DNA
atggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctactacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgcagtgagccaggattgtgcgactgcactccagcctgggtgacagggtgaaacgccatctcaaaaaataaaaattgaaaaataaaaaaagaa

SEQ ID NO: 4363 - DNA, 1477 bp, synthetic construct; identical to SEQ ID NO: 3404
  misc_feature 1..1477: note = Synthetic polypeptide
  source 1..1477: mol_type = other DNA

SEQ ID NO: 4364 - DNA, 232 bp, synthetic construct
  misc_feature 1..232: note = Synthetic polypeptide
  source 1..232: mol_type = other DNA
atgcggcggcgctcgcggatgctgctctgcttcgccttcctgtgggtgctgggcatcgcctactacatgtactcggggggcggctctgcgctggccgggggcgcgggcggcggcgccggcaggaagctccagactctgtgctctgttctgcagtgttggagctaggaccgcacatcccagctgctttgccagtggcttccgggccacctccatcagcaggaggcggtagaag

SEQ ID NO: 4365 - DNA, 592 bp, synthetic construct; identical to SEQ ID NO: 1275
  misc_feature 1..592: note = Synthetic polypeptide
  source 1..592: mol_type = other DNA

SEQ ID NO: 4366 - DNA, 180 bp, synthetic construct; identical to SEQ ID NO: 2259
  misc_feature 1..180: note = Synthetic polypeptide
  source 1..180: mol_type = other DNA

SEQ ID NO: 4367 - DNA, 7808 bp, synthetic construct; identical to SEQ ID NO: 1143
  misc_feature 1..7808: note = Synthetic polypeptide
  source 1..7808: mol_type = other DNA

SEQ ID NO: 4368 - DNA, 1874 bp, synthetic construct; identical to SEQ ID NO: 1144
  misc_feature 1..1874: note = Synthetic polypeptide
  source 1..1874: mol_type = other DNA

SEQ ID NO: 4369 - DNA, 400 bp, synthetic construct
  misc_feature 1..400: note = Synthetic polypeptide
  source 1..400: mol_type = other DNA
atggccctcaagatggtgaagggcagcatcgaccgcatgttcgacaagaatctgcaggacttggtccgcggcatccgtaaccacaaggaggacgaggccgggcgcagtggctcatgcctgttatcctggcactttgggaggctgaggcgagcagatcacctgaggtcaggaattcgagaccagcctggccaacgtggcgaaaccccgtctctaccaaaaatacaagaattagctgggcatggtggtgtgcccctgtaatcctagctactcaggaggctgagccaggagaatcacttgaacctgggaggtgaaggttgcagtgagccgagattgtgccactgcactccagcctggcatcagagcgagactccgtctcaaaaaaaaaaaaaaaaaaaaaaga

SEQ ID NO: 4370 - DNA, 763 bp, synthetic construct; identical to SEQ ID NO: 261
  misc_feature 1..763: note = Synthetic polypeptide
  source 1..763: mol_type = other DNA

SEQ ID NO: 4371 - DNA, 646 bp, synthetic construct; identical to SEQ ID NO: 262
  misc_feature 1..646: note = Synthetic polypeptide
  source 1..646: mol_type = other DNA

SEQ ID NO: 4372 - DNA, 662 bp, synthetic construct
  misc_feature 1..662: note = Synthetic polypeptide
  source 1..662: mol_type = other DNA
atgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccaggtatacactcaagagaactgaaaacaagtgctcaagcagaaacttgtacatgaatgttcatcccatcattattcacaatagccaaaaaattgaaacagcccaaatgctcatcagccaatgagtggagaaacaaaacatggtaagtcatacaaagaatgaagtgctgattaatgatacagtcatggaggaactttaaaaacattgtgctacataaaagaaaccagacaccaggccacatattcaacaaggccatttatatgaaatatccagaataagcaaatgcatagacacaggcagcagatgactgattgccaggggctgaggagaaaaaggggaatggtgagtgacagcttaatgggtatcgattgcttttgaggatgatgaaagttctggaattagatggtggtggtgggttgcataacatagtgaatgtattaaaagccactaaattgtataatttaaggtggttaaaatggattttatgttctatgaatgttacctcaataaaaa

SEQ ID NO: 4373 - DNA, 1065 bp, synthetic construct
  misc_feature 1..1065: note = Synthetic polypeptide
  source 1..1065: mol_type = other DNA
atggcccgggagaggccgcccgggaggggctgcggcgtcctgcgccggtgtctactcggggctgtgctgttgttcggcctgcggctctgcgcagagctgcggcgcgccgggcccgggtcccccacccgcagcgccccgccgggcccggcctggcggccacctgggccgcacctgccgcccgcgccgggccagccgcgcggcgccagcaggaggcaggtgacctacgtgcgcagcggtcgccgggcgccgccggggggcggcgggagcgggacgccggagcctggctgctgtgccccgcgcgggcgcccccgccggaagggtccccggtggcatatagatctccagccttgggcaggctctgctcagtccctggatgaagaagcctggaggttcctgagatatatcagcaccacccagattgcatgcaatcacatgaatacagacagcctggctactgactctagtcctacacacaagccctggtcagtgtgtcttgacgacaggttcaatttagctcatcaaatccgcaacaagcagtgccgcctctactccttagggctaggaagtgatgatacccattttgaggttagcatggccaacaacggatgtgaagtgcatcgttttgatcctagtgtcaagtcagctcacattctggagagtcagcacctttggtatcaccgcttgtccattgactggcgggatccccatccagctgttgctgcccaaaaaccacatagcaacaccagaaaactgggaagcattttgaatgaatttggacatcacaagattgacgttctcaaggcagatctggaaagtgcagaatggaaagttttggaaaatcttattctggaagatgttcttgagcagattggacagctcatctttgagatccatctccactggcctgggtttgagaaggatgtgtttgcttccccttccaccacgactgtaagtttcctgaggcctcgccagccatgctaaactgtgagtcaattaaatctctttcctctataaattactcagtctcaggtatatcttcatagcagtgtgagaatggactaatac

SEQ ID NO: 4374 - DNA, 298 bp, synthetic construct; identical to SEQ ID NO: 190
  misc_feature 1..298: note = Synthetic polypeptide
  source 1..298: mol_type = other DNA

SEQ ID NO: 4375 - DNA, 316 bp, synthetic construct; identical to SEQ ID NO: 191
  misc_feature 1..316: note = Synthetic polypeptide
  source 1..316: mol_type = other DNA

SEQ ID NO: 4376 - DNA, 211 bp, synthetic construct; identical to SEQ ID NO: 193
  misc_feature 1..211: note = Synthetic polypeptide
  source 1..211: mol_type = other DNA

SEQ ID NO: 4377 - DNA, 439 bp, synthetic construct; identical to SEQ ID NO: 198
  misc_feature 1..439: note = Synthetic polypeptide
  source 1..439: mol_type = other DNA

SEQ ID NO: 4378 - DNA, 301 bp, synthetic construct; identical to SEQ ID NO: 199
  misc_feature 1..301: note = Synthetic polypeptide
  source 1..301: mol_type = other DNA

SEQ ID NO: 4379 - DNA, 478 bp, synthetic construct; identical to SEQ ID NO: 200
  misc_feature 1..478: note = Synthetic polypeptide
  source 1..478: mol_type = other DNA

SEQ ID NO: 4380 - DNA, 11108 bp, synthetic construct
  misc_feature 1..11108: note = Synthetic polypeptide
  source 1..11108: mol_type = other DNA
atgactgcctggctgatctctctgatgagtattgaagtactacttttggcagtacgtcacctgagtttacatattgaacctgaagaaggtagccttgcagggggaacgtggatcacagtcatttttgatggtttggagttgggtgttctttaccccaacaatggctctcaattggagatacacctggtgaacgtgaacatggtggtgcccgcactgcggagtgttccctgtgacgtctttcctgttttcttggatttgcctgtggtgacatgccggaccagatctgtgctgtctgaagcacatgagggtctgtacttcctggaagcatacttcgggggacagctggtaagcagtccaaatccaggaccacgagatagctgtactttcaagttttccaaggcgcagacacccatcgttcaccaagtttatccaccaagtggtgttccaggaaaactaatacatgtatatggctggattatcactggaagattggaaacttttgattttgatgctgagtacattgatagcccagtgatcttggaagctcaaggagacaaatgggttactccttgctctcttataaataggcagatgggaagctgttatcctattcaggaggaccatggtcttgggactctgcagtgccatgtggaaggcgactacatcggctcccagaatgttagcttctcagtatttaacaaaggaaagtcaatggtccacaagaaggcatggctgatcagtgctaaacaggatcttttcctataccagacacactcagaaatattatctgtgtttccagaaactgggagccttgggggaagaacaaacatcacaattacaggagacttttttgacaattctgcccaggttaccattgcaggcattccatgtgatattagacacgtgtctcccaggaagattgagtgcaccactcgggctccaggaaaagatgtgaggctcaccacccctcagccaggcaatcgagggcttctttttgaagttggagatgctgttgagggactggaactgactgaagccaccccagggtacaggtggcagattgtccctaatgccagttctccatttgggttttggtcacaggaaggacaacctttcagagcacggctcagtgggttctttgtggctccagagacaaataattacactttctggattcaggcagatagccaagcttccttgcatttcagttggtcagaggaaccaaggactaaggtgaaagtggcctccatcagcgtcggcactgctgactggtttgactcctgggagcagaatagggatgaagggacctggcagcagaagactcccaagttggagctgttgggtggagccatgtactacctggaagcagagcatcatgggatagccccaagcagggggatgaggattggtgtccagattcacaacacctggctgaatcctgatgtggtcaccacttacctacgggagaagcaccagatccgagtccgagcccagaggcttccagaagtacaggtgctgaatgtatcaggcagaggaaacttcttccttacttgggacaatgtctctagtcagccaatccctgcaaatgccacagcccatctgattcaaacaaccattgaggagttacttgcagtaaaatgcaaactggaacccctttggtctaacatccttctccggcttggatttgaacgaggcccagaagtttccaactctgatggggacctcaccagtgggacggagcccttctgtggcaggttcagcctccgtcagcctcgacaccttgtccttactcccccggctgcccagaagggctatcggctagatcagtatacacacctgtgtcttgcatacaaaggccacatgaacaagatcctgaagatgattgtgtccttcacaatcggctttcaaaacatggtaaagaataccacctgtgactggagtctcacgaggaccagccccgagagctggcagttcgattgcactgacctctgggagacttgtgtgcgttgcttcggggatctccagccccctccggcaaactccccagtgctggttcatcagatcaaccttctccctctggcccaggagacgggcctgttctatgtggatgaaattattattgcagacacaaacgtaacagtttctcaagctgattctggaacggctcgcccagggggcaatctggtggaatcagtctctgtggtgggatcccctccggtctacagtgtcacctcctggctggcggggtgtggcacggagctcccgctcatcactgcacgctctgtgcccactgaaggaacagaagagggatctggactggtcctggtgacgacacagagacgacagcggacaagtccacctctaggaggacactttcgcatccagcttcctaatacagtgatttctgatgtccctgtacaaatttctgctcatcaccttcaccagctcttacagaataatgccgatgacttcacatccaggtacctcaatgccagtgacttcactgtgaaggaggatctatacacttgctacgaacacgtgtggaccttgtcctggtccactcagattggggatttgcccaattttatcagggtctctgatgaaaaccttactggagtgaatcctgctgcagccacgcgtgtggtatatgatggtggagtttttcttggacccatatttggagacatgttggctactgccaaccagcatactcaggtggttgtgcgagtgaatgatgtaccagctcattgcccaggttcctgctctttccagtacctccaagggtcaactccctgtgtccattctgtgtggtactccattgatggtgacatcaacctaatgatttacattaccggaactggtttctctggtgactcccagttcttgcaggttacagtgaacaaaacgagttgcaaagttattttctcaaaccagaccaatgtagtctgtcagacagatttgctacctgttggaatgcatcggatcttgatgttggtgagaccctctggtcttgccatcagtgccactggagaagacctcttcctaaatgtgaaacctagactggatatggtggagccttccagagctgcggatattggagggctctgggccaccatccgaggctctagtttggaaggtgttagcctgatattatttggatcttactcgtgtgccatcaatgtcgctacaagcaattcaagcagaattcagtgcaaagttccacccagggggaaagatggacgcattgtgaatgtgactgtgatcagaggggactattctgcagttcttcccagagcatttacatatgtctcttccttaaatccagttattgtgactctgagcagaaacataagcaatatagcaggcggtgagaccctggtcattggagtggcgaggctgatgaactatacggatttggatgtggaagtccacgtccaggatgccttggctccggttcacacacagtcggcttggggcctggaggtggcactgcccccactgccagctggtctccacagaatttccgtctctatcaatggggtcagcattcactcacaaggggttgatctccacatccagtacctcacagaagttttcagcatcgagccttgctgtgggtccctgctgggagggaccatcctcagcatctcaggaataggcttcagcagggacccagctttggtttgggtacttgtgggcaatcggtcctgtgacattgtgaacttaacggaggcgagcatctggtgtgaaaccctgccagccccccagatacccgatgcgggcgctcccactgttccagctgccgtggaggtctgggctggcaacaggttcttcgcccgtggtccttcaccaagcttggtggggaaaggcttcaccttcatgtatgaagcggcagcaacaccagtagtcactgccatgcaaggagaaatcacaaatagcagcctgagcctgcatgtgggaggaagtaacctctccaactcagtcatccttctggggaacctgaactgtgatgttgagacacagtccttccagggcaacgtgagcctgtctggatgctccatccctcttcacagtctggaggctggcatctatcctctccaagtacgtcagaagcagatgggatttgctaatatgtctgtggtgctccagcaatttgcagtgatgcctcggataatggccatcttcccatcgcagggttcggcatgtggtgggaccatacttactgtgagggggttgcttcttaactctagaaggaggtcagttcgggttgacctctcgggtccttttacttgtgtgattttgagtttgggagaccacaccattctctgccaggttagcctggagggtgaccccttgcctggagcttccttctccctgaacgtcacagtcctggtcaatgggctaaccagcgagtgtcaggggaattgcactcttttcataagggaagaggcaagtcctgtcatggatgccttgtccacaaacaccagtgggtctctgaccactgtgctgattaggggtcagaggttagccaccacagctgatgagccgatggtatttgtggatgatcaacttccttgcaatgtaactttttttaatgcaagccacgttgtgtgccagacaagagacttggccccaggaccccactacctgtcagttttttatacaagaaatgggtatgcttgttctggtaatgtttccagacacttctacattatgccccaagtgtttcattattttcctaagaatttcagcttacatggtggaagcctcttgaccatagagggcacaggcctgagaggacagaacaccacgtcagtctatattgaccagcagacctgcctgacggtgaacatcggtgctgagctcatccggtgcattgttcccacagggaatggctctgttgccctggaaatagaggtagatggactttggtatcacataggagtcattggttataacaaggcctttaccccagaattgatctctatttctcagagcgatgacatcttaacctttgcagtggcccagatctcaggagctgcaaacattgacatttttataggaatgtcaccctgtgtgggtgtctctggtaaccacaccgttcttcagtgcgtggtcccttcccttccggccggggagtaccacgtcagaggctatgactgcatcagagggtgggcctcatctgccctggtgttcacctcaagagttattattacagcagtgacggagaacttcggctgcctgggtggaaggctggtgcatgtgtttggagcgggattttctccagggaatgtctcagctgctgtgtgtggtgctccctgccgagtcctggctaatgctacagtgtctgccttcagctgcttggttctgcccctggatgtgtccttggccttcctgtgtggcctgaagcgtgaggaggacagctgtgaggctgccagacacacctatgtgcagtgtgatttgacagttgccatggcgacagagcaactgcttgaatcgtggccttacctctacatttgcgaggaaagttcccaatgcctctttgtgccagatcattgggcagagtcaatgtttccatcattctcgggcctctttatcagccctaaattggaaagagatgaagttctcatctataatagctcctgtaacattaccatggaaactgaggcagagatggagtgtgagacgcccaatcagccaattaccgtcaagattactgagatacggaaacgctggggccagaacactcagggcaacttttctttacagttctgccggagatggtccaggactcacagctggtttcctgaaaggctgccacaagatggcgacaacgtcacagtggagaatggccaattgcttctgctggacactaacacaagcatcctcaacttactgcacattaaagggggcaagctgattttcatggccccaggacccatcgagctcagggcacacgccatccttgtttctgatggtggagagctccggattggatccgaagacaagcccttccaaggcagagctcagatcacactctacgggagttcctactcaactcccttctttccctatggagtcaagttcctggctgtgaggaatggaactctttctctgcacggttcactaccagaagtaattgtcacctgtcttagagcaactgcccatgccctagacacagtgctggctttagaagatgctgtggactggaaccctggggatgaagttgtcatcatcagtggaacaggtgttaaaggtgccaaaccgatggaagagattgtcactgtggaaactgtgcaggatacagacctctatcttaagtcacctttgagatattctcacaactttacagagaattgggtggctggagagcaccatattttaaaggccactgtggctctgctcagcaggagtattaccatacaaggaaatctcactaatgagagggagaagctgcttgtttcatgccaggaggccaatgctccagaaggtaatctgcagcactgtttgtattccatgagtgagaagatgctaggatccagggatatgggagccagagtgatcgttcagtccttcccagaagagcccagccaggtccagttgaagggagtgcagtttcaagtcttggggcaagccttccataagcatctgagctcactcactctggtgggagctatgagagagtctttcatacagggctgcacagtgaggaactccttcagtagaggcctcagcatgtgcgggaccttgggcctgaaggtggacagtaatgtattctacaatattttaggtcatgcgctgctagttgggacatgcacggagatgagatatatctcctgggaggcaattcatggaaggaaagatgactggtcaggacatggaaatataataagaaacaacgtgatcatccaggtttctggtgccgagggactctccaatcctgaaatgttgacaccatctggcatctatatctgcagtcccaccaatgttatagaggggaacagagtgtgtggtgctggctatggctactttttccatctcatgaccaaccaaacatcacaagctccgcttctttccttcactcagaacattgcacattcttgtaccaggtatggtctctttgtataccctaaatttcagccaccttgggataatgtcactggcaccactctgttccagagcttcacagtttgggaaagtgcaggtggtgcccagatttttagaagtagcaatcttcgcctgaaaaacttcaaagtttattcatgcagagattttggaattgacgtcttggaaagtgatgcaaatacttcagttactgacagcttattacttggtcattttgcccacaagggaagtctgtgtatgtcatctgggattaaaactcctaaaagatgggaactgatggtgtctaacacaacctttgttaattttgatctcatcaactgtgtggccattagaacctgttcagactgttcccaaggacaaggtggatttactgtgaagaccagccagttgaagtttacaaactcttcaaacttagtggcatttccatttcctcatgcagcaattttggaagacttggatgggtctctgtctgggaaaaacagaagtcacattcttgcttctatggaaaccctttcagcttcttgtttggtcaattcaagctttggtcgggttgtccatggcagtgcctgtggaggaggtgttctttttcatcgtatgtctattggtttagcgaatactcctgaagtttcttatgatttaaccatgactgacagcagaaataaaacaaccactgtcaattatgtacgtgatacattgtctaaccctcgtggctggatggctctgctcttggaccaagagacctactcattgcaatctgagaacctttggatcaacagatctctgcagtactcagcaacctttgacaactttgctcctggtaattacctactgctggtgcacacagatttgccgccttaccctgacatcctcctaagatgtgggagtcgagtgggtctgtcttttccatttcttccatcaccaggtcagaaccaaggctgtgactggttcttcaatagccagctgaggcaactcacctatctggtttcaggtgaaggccaagttcaagtcattctccgggtgaaggaaggtatgcccccaactatttcagcttctacctctgcccctgaatcagctttaaaatggtccctccctgaaacatggcaaggtgttgaagaaggctggggaggatacaacaataccattccaggccctggggatgacgttctcattttacccaacagaactgtccttgtggatacagatcttccattcttcaaagggctgtatgtgatggggaccttagacttccctgtggacagaagcaatgttctgagtgtggcatgcatggtcattgcaggcggggagctgaaagttggtactttagaaaatcccttagaaaaggaacaaaagcttctgattctccttagagcctcagagggagtcttttgtgaccgtatgaatggaattcatattgacccaggaacaattggggtttatgggaaagttcatctttacagtgcttatcctaagaactcctggacacatcttggagctgatattgcctcaggaaatgagagaattatagtagaagatgcagtggattggcgcccccatgacaaaatagtccttagctcctcttcttatgagcctcatgaagcagaggtcctcactgtgaaagaagtcaagggccaccatgtgaggatctatgaacggctcaaacaccggcatattggaagtgtacatgtcacggaggatggccgacacattcgtttggctgctgaggttggactgttgacccgaaatatacaaattcagcctgacgtatcatgtagggggagactgtttgtggggtccttcaggaagtccagccgagaagaattttcaggtgtccttcaacttcttaatgtggaaattcagaacttcgggtcaccattgtactcatctgttgaattcagtaatgtgtcagcaggatcctggatcatatcatctactctgcaccagagctgtggcgggggcattcatgcagctgccagtcatggagtacttttaaatgacaatattgtgtttggcacagctggccatggcatagatttagagggtcaggcctatactgtcactaataaccttgtggttctgatgacacagccagcgtggtccaccatttgggtggcgggaatcaaagtgaaccaggtaaaggacatcaacctccatggcaacgttgtggcaggatcagagagacttggctttcacatccgaggccacaagtgctcctcttgtgaactgctttggtctgacaatgtggcgcattcaagtcttcatggccttcatctctataaggaaagtggacttgacaactgtaccagaatctctggcttcttggctttcaagaactttgactatggtgccatgttacatgtagagaacagcgtggagatagagaacattactctggtagacaatactattggtcttttggcagtagtgtatgtattttctgctccacaaaattccgtcaaaaaagtgcagattgtgcttaggaattcagtcattgtggccaccagctcttcttttgactgcattcaggacaaagtgaagccgcactcagccaacttgacatcaacagatagagctccctccaatccaagaggaggtcgaattggtattctgtggcctgtattcacctcagaaccaaatcagtggcctcaggagccatggcacaaagtgaggaatgatcattcaatttcaggaatcatgaaacttcaagatgttaccttttctagttttgtgaagagttgctatagcgatgacctggatgtctgcattctaccaaatgcagagaacagtggaattatgcacccaataacagcagagaggaccaggatgctaaagataaaagataaaaacaagttctactttccttcattacaacccaggaaagatttaggaaaagtagtctgtcctgaattagactgtgcaagtccaagaaaatatctcttcaaggatctggatgggagagccctgggtctgcctccaccagtttctgtatttcctaaaacagaggcagaatggactgcatccttcttcaacgcaggaccaagactgaaataccatcaaatgctgatgacttccaatttatatcctcagcctagactcgaccctgaaatttggtctagtatagccaactgactttacttggaaagatagtagacatctcagactcaatatgcctcaaaaagattcttgatctcttccccaatctacaacctgcttcttgcctagctgtccctacctcagtaattggtgccaccattcattaggctatttaagtaaaaaacctgggagtcatcttttatttttctttttcctaacccaaattctcaaacttctcatttcctccactactaccaccctcaccattccctttactactagccaccattgtctctcactagatgagggaatagcctccttgctggtcttctttcttctacttttgtagtctctagtctattcttcacacatggccagagggatattttcagctttccacccattcagaatgaagtcccagctacaagcctgtaagtcttgtagcccctggttcctgcccactctctcacctcctctcttgtgacacgccttttacttacttatcctggtctcttatttttcgtttaacatggtatgtgtatcactacatcagggcgtttgtgctggctttttcctcttcctggaatattttattctcacttctttgggagctagttcccgctgttcaaataaggtaccctcagagaagccatccttgaccaccctatctaaaataatcatgagatcatttttctgtagctctactgtgcttgctttattgtttgttagagtcgtggtacttaacattatattataaatgtaattgcttatgttaatgtactgtttatcctttttagaacacaaacttcatgagggcaggattttttttttgttgttcactgatgtgtatttgggggttactcaataaattttggttgactgatcaaatgaat

SEQ ID NO: 4381 - DNA, 479 bp, synthetic construct
  misc_feature 1..479: note = Synthetic polypeptide
  source 1..479: mol_type = other DNA
atgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagaggattacttgagcccaggaatttgagaccagcttgggcaacataggaagaccggtctctactaaaaaaagaaaccaaacaaacaaattagctgggcatagtgacgcacacctgtagtcccagccagctacttgtgaggctgaggtgggacaattgcttgagcccaggtgttcaagactgcagtgagccctgattgtgaca

SEQ ID NO: 4382 - DNA, 473 bp, synthetic construct
  misc_feature 1..473: note = Synthetic polypeptide
  source 1..473: mol_type = other DNA
cttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacatgcttatttaccgtgtcaaaacagagaagtgaacttcgactatgattataaagcacagtggagtggagatttttattgtaggaattacaaagcaaagtactaaactgacactgtaggtaagctaataatatacatccacattaccggactataatcacttatcacaactgtcacatgttctcaaactgacaggaaagcaactgtcagaaaaattataacctttagaaatggaatattagatcccagcagaattttttcacaaaaattaatgaaagtgaggc

SEQ ID NO: 4383 - DNA, 1003 bp, synthetic construct
  misc_feature 1..1003: note = Synthetic polypeptide
  source 1..1003: mol_type = other DNA
atggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacatgcttatttaccgtgtcaaaacagagaagtgaacttcgactatgattataaagcacagtggagtggagatttttattgtaggaattacaaagcaaagtactaaactgacactgtaggtaagctaataatatacatccacattaccggactataatcacttatcacaactgtcacatgttctcaaactgacaggaaagcaactgtcagaaaaattataacctttagaaatggaatattagatcccagcagaattttttcacaaaaattaatgaaagtgaggc

SEQ ID NO: 4384 - DNA, 724 bp, synthetic construct
  misc_feature 1..724: note = Synthetic polypeptide
  source 1..724: mol_type = other DNA
atgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacatgcttatttaccgtgtcaaaacagagaagtgaacttcgactatgattataaagcacagtggagtggagatttttattgtaggaattacaaagcaaagtactaaactgacactgtaggtaagctaataatatacatccacattaccggactataatcacttatcacaactgtcacatgttctcaaactgacaggaaagcaactgtcagaaaaattataacctttagaaatggaatattagatcccagcagaattttttcacaaaaattaatgaaagtgaggc

SEQ ID NO: 4385 - DNA, 622 bp, synthetic construct
  misc_feature 1..622: note = Synthetic polypeptide
  source 1..622: mol_type = other DNA
atggcggagtacgacttgactactcgcatcgcgcactttttggatcggcatctagtctttccgcttcttgaatttctctctgtaaaggaggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacatgcttatttaccgtgtcaaaacagagaagtgaacttcgactatgattataaagcacagtggagtggagatttttattgtaggaattacaaagcaaagtactaaactgacactgtaggtaagctaataatatacatccacattaccggactataatcacttatcacaactgtcacatgttctcaaactgacaggaaagcaactgtcagaaaaattataacctttagaaatggaatattagatcccagcagaattttttcacaaaaattaatgaaagtgaggc

SEQ ID NO: 4386 - DNA, 1363 bp, synthetic construct
  misc_feature 1..1363: note = Synthetic polypeptide
  source 1..1363: mol_type = other DNA
atgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaagatatctcaggatgaacctcctccataagaccagaagtcttctgcctctccacatctgctcttcctcctgtatctcctattgcagtaaataacaatgatcactactcagtccctcaaactaaaattctgggaaccattttcagttctcccttgtctaccataaggattttgtcaccaaatctgttggttctctggatgttttccaaatccacaaagtgctatcacatctc

SEQ ID NO: 4387 - DNA, 465 bp, synthetic construct; identical to SEQ ID NO: 3964
  misc_feature 1..465: note = Synthetic polypeptide
  source 1..465: mol_type = other DNA

SEQ ID NO: 4388 - DNA, 1026 bp, synthetic construct; identical to SEQ ID NO: 2114
  misc_feature 1..1026: note = Synthetic polypeptide
  source 1..1026: mol_type = other DNA

SEQ ID NO: 4389 - DNA, 441 bp, synthetic construct
  misc_feature 1..441: note = Synthetic polypeptide
  source 1..441: mol_type = other DNA
atgagcggcttcagcaccgaggagcgcgccgcgcccttctccctggagtaccgagtcttcctcaaaaatgagaaaggacaatatatatctccatttcatgatattccaatttatgcagataagggacatggatgaagctggaaaccatcattctcagcaaactgttgcaaggacaaaaaaccaaacaccgcatttctcactcataggtgggaattgaacaatgagaacacgtggacacaggaaggggaacatcacacaccggggcctgttgtggggtggggggagggggaaaggatagtattaggagatatacctaatgctaaatgatgagttaatgggtgcagcacaccaacatgcaacatggcacatgtatacatatgtaacaaacctgcactttgtgcacatataccctaaaacttaaagtataataataaaaaaaaa

SEQ ID NO: 4390 - DNA, 288 bp, synthetic construct
  misc_feature 1..288: note = Synthetic polypeptide
  source 1..288: mol_type = other DNA
atggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagtattgttgttttt

SEQ ID NO: 4391 - DNA, 1519 bp, synthetic construct
  misc_feature 1..1519: note = Synthetic polypeptide
  source 1..1519: mol_type = other DNA
atggatgatgtcctgcccctgatgccttgggagaccctgttggcacagggcagtccccagggctcgcctgacctcccagcagggcagcggaagcagcagccacagggtgacagggcccagggcctggcctctgagtcctggaagctcctggaggtgcccatcattcacataacgccatccagtgatggggagtcccccgcctgcaccccaaccccccgacgccggcagcagcagaggatgccagacccgcagagtctgtcccaggacagcaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcatggcagggtgaacacaagcacagactgaaggcagcttgccgcggttcacatcctggtcacaccacttcctgaccatgtcacgtgggcaaattatgtaacttctctgagcttgctttcctcctctgaaaatggggttaacaatgataatacccacttcataggattgttgttaagagactataaatga

SEQ ID NO: 4392 - DNA, 1258 bp, synthetic construct
  misc_feature 1..1258: note = Synthetic polypeptide
  source 1..1258: mol_type = other DNA
atgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcatggcagggtgaacacaagcacagactgaaggcagcttgccgcggttcacatcctggtcacaccacttcctgaccatgtcacgtgggcaaattatgtaacttctctgagcttgctttcctcctctgaaaatggggttaacaatgataatacccacttcataggattgttgttaagagactataaatga

SEQ ID NO: 4393 - DNA, 556 bp, synthetic construct
  misc_feature 1..556: note = Synthetic polypeptide
  source 1..556: mol_type = other DNA
atgcactgcttgaaaaggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcatggcagggtgaacacaagcacagactgaaggcagcttgccgcggttcacatcctggtcacaccacttcctgaccatgtcacgtgggcaaattatgtaacttctctgagcttgctttcctcctctgaaaatggggttaacaatgataatacccacttcataggattgttgttaagagactataaatga

SEQ ID NO: 4394 - DNA, 1237 bp, synthetic construct
  misc_feature 1..1237: note = Synthetic polypeptide
  source 1..1237: mol_type = other DNA
atgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcatggcagggtgaacacaagcacagactgaaggcagcttgccgcggttcacatcctggtcacaccacttcctgaccatgtcacgtgggcaaattatgtaacttctctgagcttgctttcctcctctgaaaatggggttaacaatgataatacccacttcataggattgttgttaagagactataaatga

SEQ ID NO: 4395 - DNA, 668 bp, synthetic construct
  misc_feature 1..668: note = Synthetic polypeptide
  source 1..668: mol_type = other DNA
atggagaagcccctcttcccattagtgcctttgcattggtttggctttggctacacagcactggttgtttctggtgggatcgttggctatgtaaaaacagccgctacatctgttacttttgttggtgttatgggaatgagatcctactactatggaaaattcatgcctgtaggtttaattgcaggtgccagatggagtatggctcttgttgcccaagctggggtgcaatggtgcgatctcagctcattgcaacctccacctcccaggttcaagcgattctcctgccttaccctcctgagtagctgggatttcagaccctgcacttgatggatcacctggcaccgcccaaattgataaactggctcatctgatcttgtggcccccatccaggaactgactcagtgcaagacaacagcttgcactccctatgacttaatctcccaccggaccagtcagcactcctgagtcacctggctgcccctggcacaccaagtaacccttaaacacttcaatccttgaatgctctgggagactgatttgagtaccaataaaactccagtctcctgcacagctggctctgcgtgtgctctttctctattgcaattccctgtcttgataactcagctctgtctaggcaaagggcaaagtgaacccattgggccattaca

SEQ ID NO: 4396 - DNA, 770 bp, synthetic construct
  misc_feature 1..770: note = Synthetic polypeptide
  source 1..770: mol_type = other DNA
atggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagatggagtatggctcttgttgcccaagctggggtgcaatggtgcgatctcagctcattgcaacctccacctcccaggttcaagcgattctcctgccttaccctcctgagtagctgggatttcagaccctgcacttgatggatcacctggcaccgcccaaattgataaactggctcatctgatcttgtggcccccatccaggaactgactcagtgcaagacaacagcttgcactccctatgacttaatctcccaccggaccagtcagcactcctgagtcacctggctgcccctggcacaccaagtaacccttaaacacttcaatccttgaatgctctgggagactgatttgagtaccaataaaactccagtctcctgcacagctggctctgcgtgtgctctttctctattgcaattccctgtcttgataactcagctctgtctaggcaaagggcaaagtgaacccattgggccattaca
